(12) United States Patent
Desantis et al.

(10) Patent No.: US 7,608,445 B1
(45) Date of Patent: Oct. 27, 2009

(54) NITRILASES, NUCLEIC ACIDS ENCODING THEM AND METHODS FOR MAKING AND USING THEM

(75) Inventors: Grace Desantis, San Diego, CA (US); Jay M. Short, Rancho Santa Fe, CA (US); Mark J. Burk, San Diego, CA (US); Kelvin Wong, San Diego, CA (US); Robert Farwell, San Diego, CA (US); Kelly Chatman, San Diego, CA (US)

(73) Assignee: Verenium Corporation, San Diego, CA (US)

( * ) Notice: Subject to any disclaimer, the term of this patent is extended or adjusted under 35 U.S.C. 154(b) by 10 days.

(21) Appl. No.: 10/514,004

(22) PCT Filed: May 15, 2003

(86) PCT No.: PCT/US03/15712

§ 371 (c)(1),
(2), (4) Date: Jun. 13, 2005

(87) PCT Pub. No.: WO03/097810

PCT Pub. Date: Nov. 27, 2003

Related U.S. Application Data

(63) Continuation-in-part of application No. 09/751,299, filed on Dec. 28, 2000, now Pat. No. 7,300,775.

(60) Provisional application No. 60/254,414, filed on Dec. 7, 2000, provisional application No. 60/173,609, filed on Dec. 29, 1999.

(51) Int. Cl.
*C12N 9/78* (2006.01)
*C12N 15/00* (2006.01)
*C12N 1/20* (2006.01)
*C12P 21/04* (2006.01)
*C12Q 1/00* (2006.01)
*A61K 38/00* (2006.01)
*C07H 21/04* (2006.01)
*C12Q 1/68* (2006.01)
*C07H 21/02* (2006.01)

(52) U.S. Cl. .............................. 435/227; 435/4; 435/6; 435/252.3; 435/320.1; 435/440; 435/69.1; 435/71.1; 536/23.1; 536/23.2; 530/350

(58) Field of Classification Search ....................... None
See application file for complete search history.

(56) References Cited

U.S. PATENT DOCUMENTS

| | | |
|---|---|---|
| 4,611,067 A | 9/1986 | Volante |
| 4,908,313 A | 3/1990 | Satoh et al. |
| 5,003,080 A | 3/1991 | Butler |
| 5,097,045 A | 3/1992 | Butler |
| 5,103,024 A | 4/1992 | Millar |
| 5,124,482 A | 6/1992 | Butler |
| 5,149,837 A | 9/1992 | Butler |
| 5,206,158 A | 4/1993 | Clifford et al. |
| 5,216,174 A | 6/1993 | Butler |
| 5,245,047 A | 9/1993 | Butler |
| 5,248,793 A | 9/1993 | Millar |
| 5,280,126 A | 1/1994 | Butler |
| 5,298,627 A | 3/1994 | Butler |
| 5,342,952 A | 8/1994 | Butler |
| 5,397,792 A | 3/1995 | Butler |
| 5,446,054 A | 8/1995 | Butler |
| 5,470,981 A | 11/1995 | Butler |
| 5,489,690 A | 2/1996 | Butler |
| 5,489,691 A | 2/1996 | Butler |
| 5,510,488 A | 4/1996 | Butler |
| 5,587,303 A | 12/1996 | Wakamoto et al. |
| 5,629,190 A | 5/1997 | Petre |
| 5,635,391 A | 6/1997 | Petre |
| 5,756,306 A | 5/1998 | Yamaguchi et al. |
| 5,811,515 A | 9/1998 | Grubbs et al. |
| 6,042,824 A | 3/2000 | Khalaf |
| 6,433,213 B1 | 8/2002 | Bosch |
| 6,596,879 B2 | 7/2003 | Bosch |
| 2002/0127609 A1 | 9/2002 | Davis et al. |

FOREIGN PATENT DOCUMENTS

| | | |
|---|---|---|
| EP | 0332379 | 9/1989 |
| EP | 0449648 | 10/1991 |
| EP | 0502476 | 9/1992 |
| EP | 0 178 106 | 3/1993 |
| EP | 0596812 | 5/1994 |
| EP | 0610048 | 8/1994 |
| EP | 0610049 | 8/1994 |
| EP | 0711836 | 5/1996 |
| EP | 0773297 | 5/1997 |
| EP | 0 780 471 | 6/1997 |
| EP | 0780471 | 6/1997 |
| JP | 61162195 | 1/1985 |
| JP | 63-500004 | 1/1988 |
| JP | 1-317392 | 12/1989 |
| JP | 4-079894 | 3/1992 |
| JP | 4-099495 | 3/1992 |
| JP | 04079894 | 3/1992 |
| JP | 6-237789 | 8/1994 |
| JP | 8-131188 | 5/1996 |
| WO | WO-86/07386 | 12/1986 |

(Continued)

OTHER PUBLICATIONS

Branden et al. Introduction to Protein Structure, Garland Publishing Inc., New York, p. 247, 1991.*

(Continued)

*Primary Examiner*—Yong D Pak
(74) *Attorney, Agent, or Firm*—Jennifer Risser

(57) ABSTRACT

The invention relates to nitrilases and to nucleic acids encoding the nitrilases. In addition methods of designing new nitrilases and method of use thereof are also provided. The nitrilases have increased activity and stability at increased pH and temperature.

11 Claims, 42 Drawing Sheets

FOREIGN PATENT DOCUMENTS

| WO | WO-91/02071 | 2/1991 |
|----|-------------|--------|
| WO | WO-91/08287 | 6/1991 |
| WO | WO-91/08316 | 6/1991 |
| WO | WO-94/24305 | 10/1994 |
| WO | WO-97/21805 | 6/1997 |
| WO | WO-98/13119 | 4/1998 |
| WO | WO-99/55310 | 11/1999 |
| WO | WO-00/03685 | 1/2000 |
| WO | WO-00/58504 | 10/2000 |
| WO | WO-01/04327 | 1/2001 |
| WO | WO-01/04331 | 1/2001 |
| WO | WO-01/14561 | 3/2001 |
| WO | WO-01/18211 | 3/2001 |
| WO | WO-01/21782 | 3/2001 |
| WO | WO-01/25438 | 4/2001 |
| WO | WO-01/29241 | 4/2001 |
| WO | WO-01/48175 | 7/2001 |
| WO | WO 02/029079 | 4/2002 |
| WO | WO-03/000840 | 1/2003 |
| WO | WO-03/004456 | 1/2003 |

OTHER PUBLICATIONS

Stalker et al. Purification and properties of a nitrilase specific for the herbicide bromoxynil and corresponding nucleotide sequence analysis of the bxn gene. J. Biol. Chem. 263, 6310-6314, 1988.*
Robertson et al. Exploring nitrilase sequence space for enantioselective catalysis. Appl. Environ. Microbiol. 70:2429- 2436(2004).*
International Search Report mailed on Jan. 5, 2006, for PCT Patent Application No.PCT/US03/15712 filed on May 13, 2003, 2 pages.
Baumann et al., Tetrahedron Letters (1992) 33:2283-2284.
Brower et al., Tetrahedron Letters (1992) 33:2279-2282.
Cohen et al., Tetrahedron Letters (1990) 31:7223-7226.
Gavagan et al., J. Org. Chem. (1998) 63:4792-4801.
Kobayashi et al., Tetrahedron (1990) 46:5587-5590.
Supplementary European Search Report for EP Application No. 02780877.3, mailed on May 8, 2008, 5 pages.
Abato et al., J Am Chem Soc (2001) 123:9206-9207.
Almatawah et al., Enzyme and Microbial Technology (1999) 25:718-724.
Baumann et al., A high-throughput screening method for the identification of active and enantioselective hydrolases, Poster P-130, presented at Bio Trans 2001, Sep. 2-7, 2001, Dramstadt, Germany.
Bhalla et al., Applied Micro Biotech (1992) 37:184-190.
Bork et al., Protein Science (1994) 3(8):1344-1346.
Business Communications Company, Amino Acids for Synthesis Applications—Introduction, Summary, Overview, Industry, Manufacture of Amino Acids, Peptide Synthesis Technologies and Amino Acid Products for Synthesis Use Section 7.2.5 Prices of Natural Amino Acids—No date.
Business Communications Company, Amino Acids for Synthesis Applications—Introduction, Summary, Overview, Industry, Manufacture of Amino Acids, Peptide Synthesis Tehcnologies and Amino Acid Pruducts for Synthesis Use Section 7.3 Unnatural Amino Acids—Feb. 1999,9 pgs.
Caruso et al., Physicochemical and Engineering Aspects (2000) 169:287-293.
Cheong et al., Enzyme and Microbial Technology (2000) 26:152-158.
Choi et al., Arch Pharm Res (1986) 9(1):45-47.
Cowan et al., Extremophiles (1998) 2:207-216.
Crosby et al., Tetrohedron Asymmetry (1992) 3(12):1547-1550.
Diaz et al., Tetrahedron Letters (2001) 42:2617-2619.
Dufour et al., FEBS Lett (1998) 433:78-82.
Duran et al., Characterization of Nitrile Hydratase Genes Cloned by DNA Screening from *Rhodococcus erythropolis* (1993) 57(8):1323-1328.
Fournand et al., Journal of Molecular Catalysis B: Enzymatic (1998) 5:207-211.
Gabriel et al., Journal of Chromatography B (1996) 681:191-195.
Gallifuoco et al., Process Biochemistry (1999) 35:179-185.
GenBank Accession No. E-01313, Sep. 29, 1997.
Graham et al., Enzyme and Microbial Technology (2000) 26:368-373.
Guo et al., Angew Chem Int Ed (1999) 38(12):1755-1758.
Hughes et al., Application of whole cell *Rhodococcal* biocatalysts in acrylic polymer manufacture, Antonie Van Leeuwenhoek, Vol. 74, Abstract.
Kim et al., Enzyme Microbiology Technology (2000) 492-501.
Kobayashi et al., Eur J Biochem (1989) 182:349-356.
Komeda et al.., PNAS USA (1996) 93(20):10572-10577.
Levy-Schil et al., Gene (1995) 161(1):15-20.
Liu et al., Determination of Organonitriles Using Enzyme-Based Selectivity Mechanisms. 2. A Nitrilase-Modified Glassy Carbon Microelectrode Sensor for Benzonitrile, Anal Chem (1995), Vol. 67, Abstract.
Mala et al., Carbohydrate Research (1999) 322:209-218.
Martino et al., Process Biochemistry (1996) 31(3):281-285.
Nagasawa et al., Microbial transformations of nitriles (1989) 7:153-158.
Novo et al., FEBS Lett (1995) 367(3):275-279.
Ogawa et al., Microbial enzymes: new industrial applications from traditional screening methods, 9 pages.
Reetz et al., Angew Chem Int Ed (1999) 38(12):1758-1761.
Reetz, Angew Chem Int Ed (2002) 41(8):1335-1338.
Rouhi, Chemical & Engineering News (2002) 80(23):51-57.
Schrader et al., Can J Chem (2002) 80:626-632.
Sequence Alignment—Yu et al.
Shen et al., Israel Journal of Chemistry (2001) 41:313-316.
Taillades et al., Bulletin De La Societe Chimique De France (1991) 128(3):423-430.
Tao et al., Anal Chem (2002) 74(15):3783-3789.
Watanabe et al., Applied Microbiology and Biotechnology (1998) 50(1):93-97.
Wiyakrutta et al., Journal of Biotechnology (1997) 55(3):193-203.
Wu et al., Analytical Letters (1977) 30(7):1399-1406.
Yao et al., Discovery of Asymmetric Catalysts Using Kinetic Resolution/Mass Spectrometry Screening, Abstract. Pap American Chemical Society, 221st ORGN-606, 2001.
Zhao et al., Journal of Chromatography B (1994) 656:441-446.
Zhou et al., Nucleotide sequence of a pathogen induced nitrilase gene from *Arabidopsis thaliana*: Nit2 (Accession No. U47114) Plant Gene Register PGR 96-006.
Robertson et al., Applied and Environmental Microbiology (2004) 70(4):2429-2436.
Supplementary Partial European Search Report for EP 03 75 3097, mailed on Sep. 21, 2007, 4 pages.

* cited by examiner

R = alkyl, aryl

Fluorescent 1-cyano-
2-substituted benzoisoindole
EX λ 320 nm, EMλ 380 nm

NITRILASE SCREENING PARADIGM

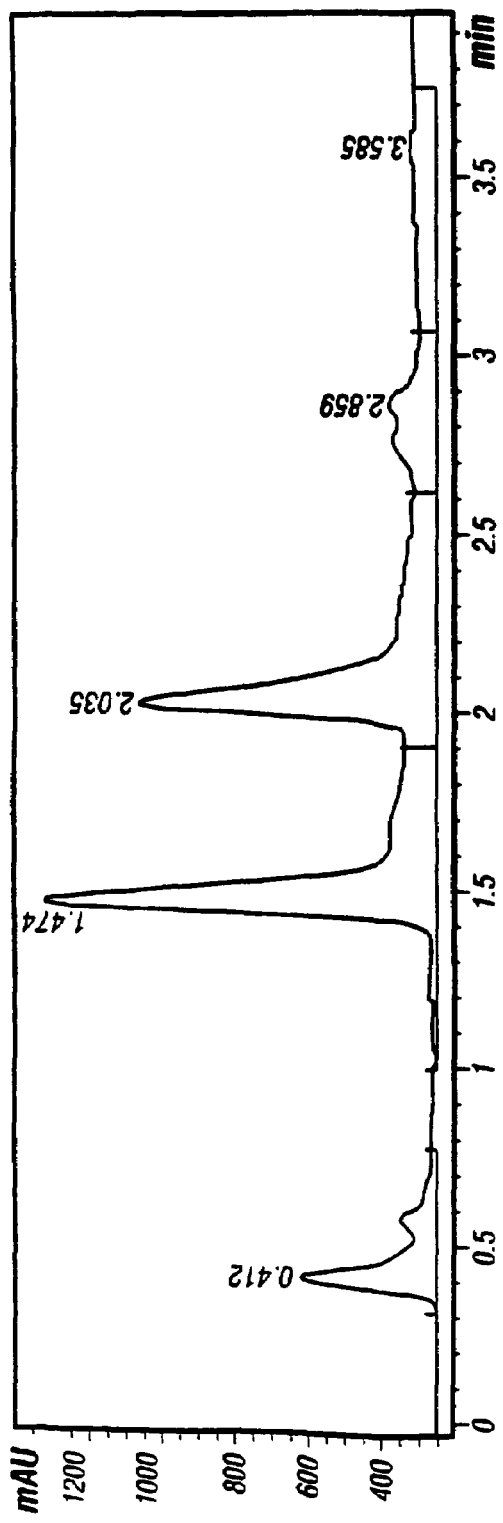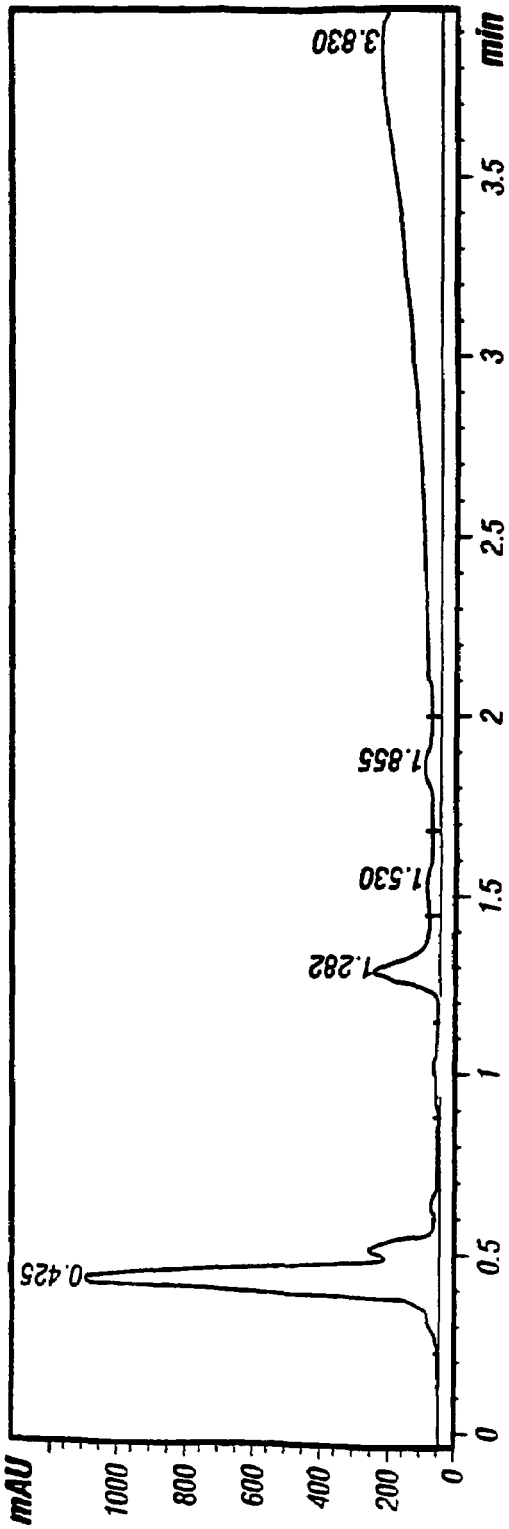

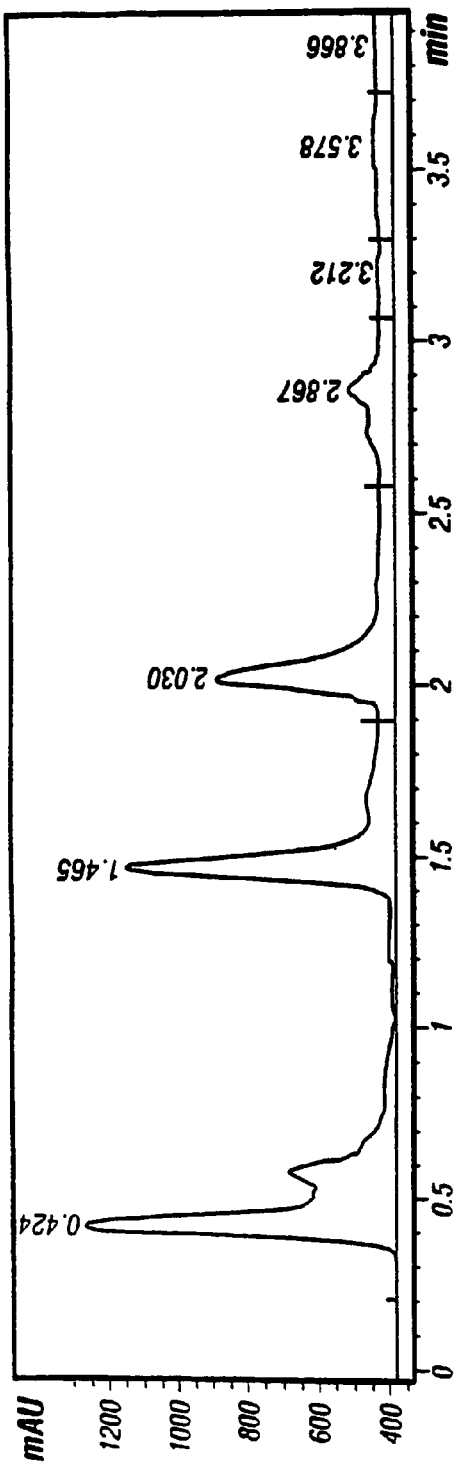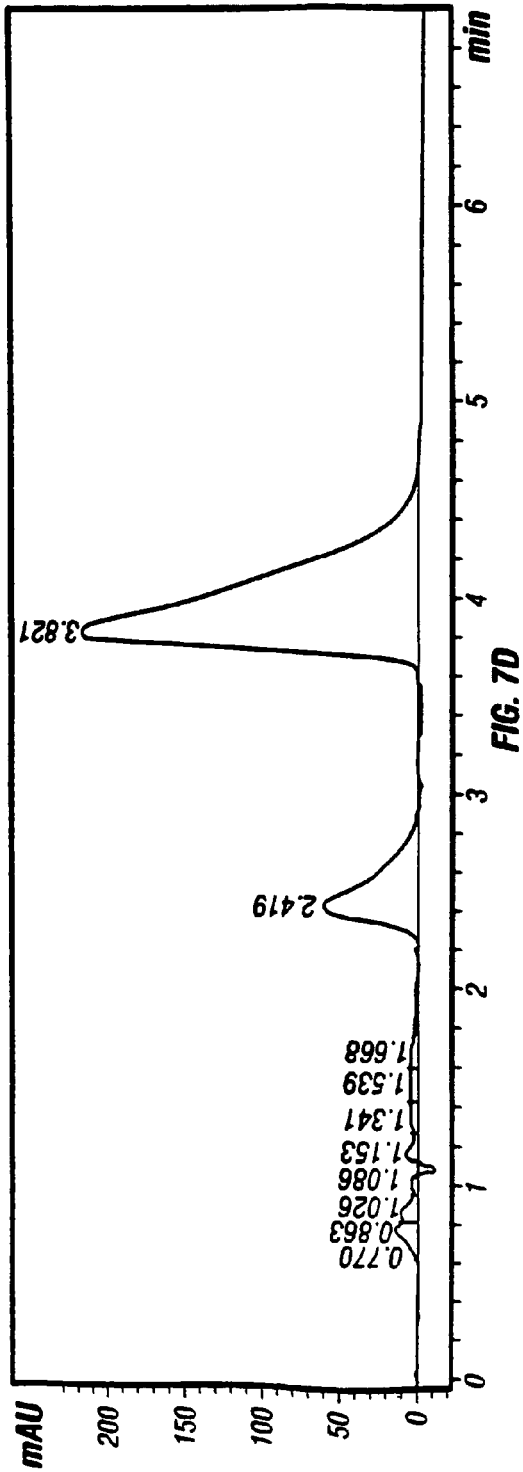

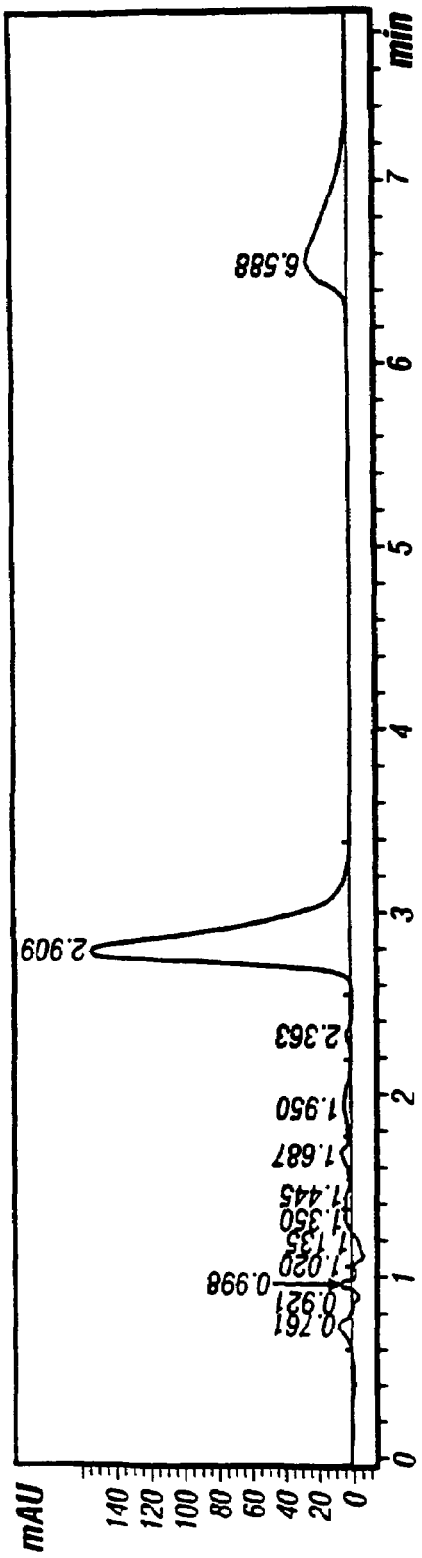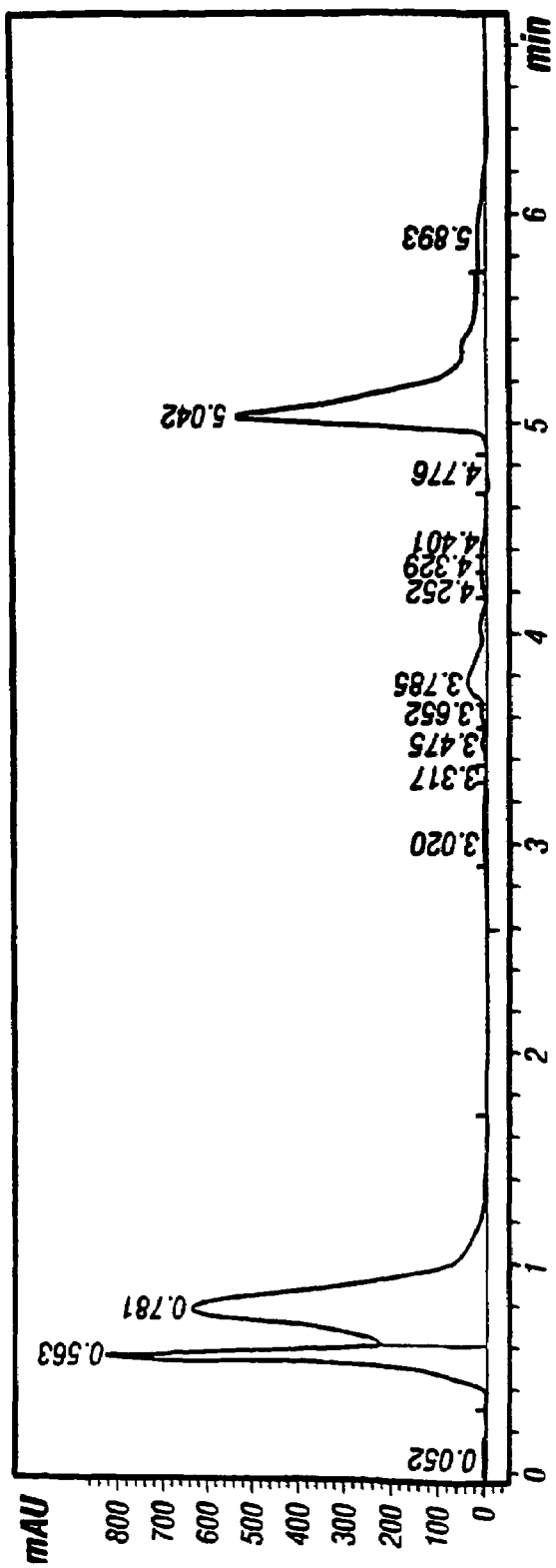

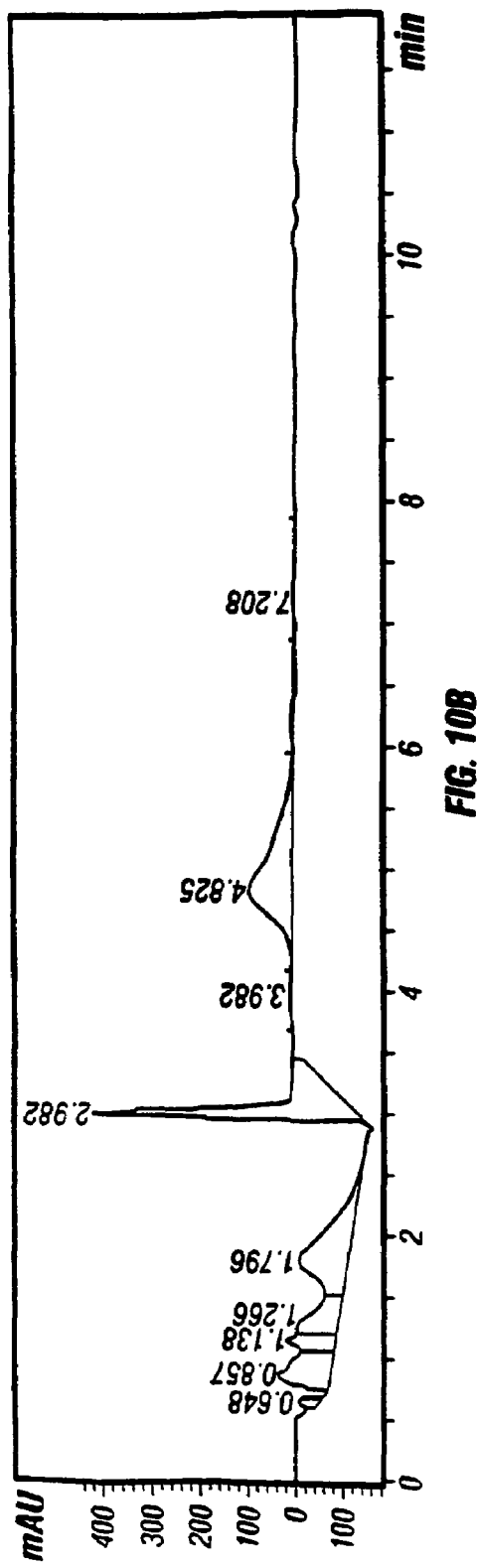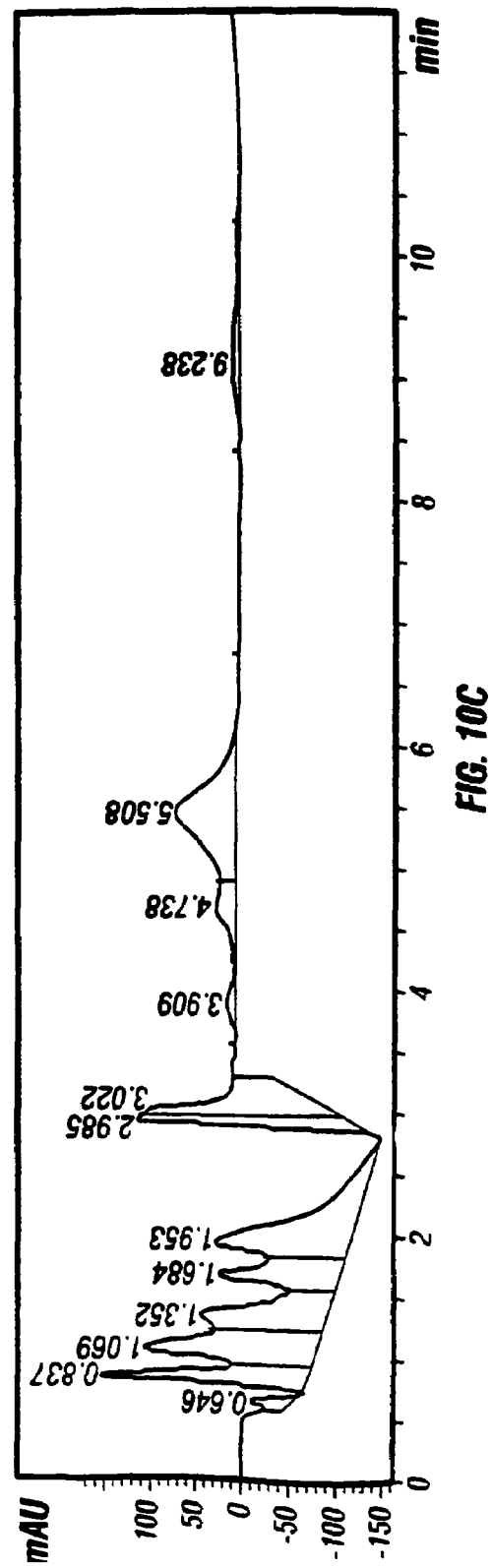
FIG. 10B
FIG. 10C

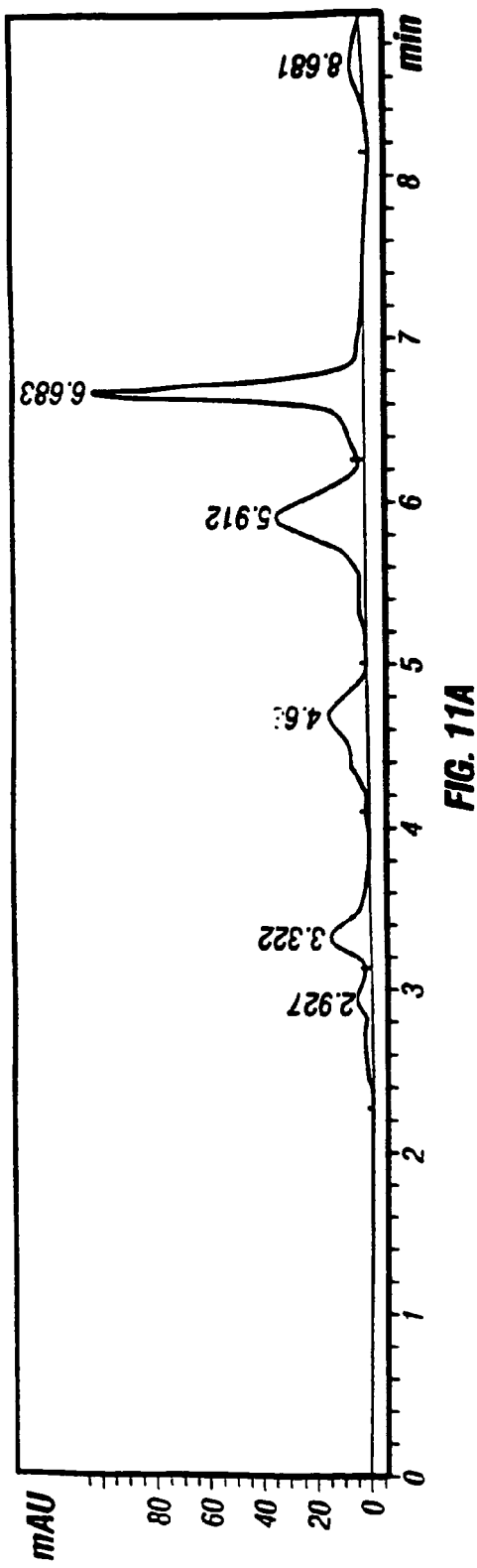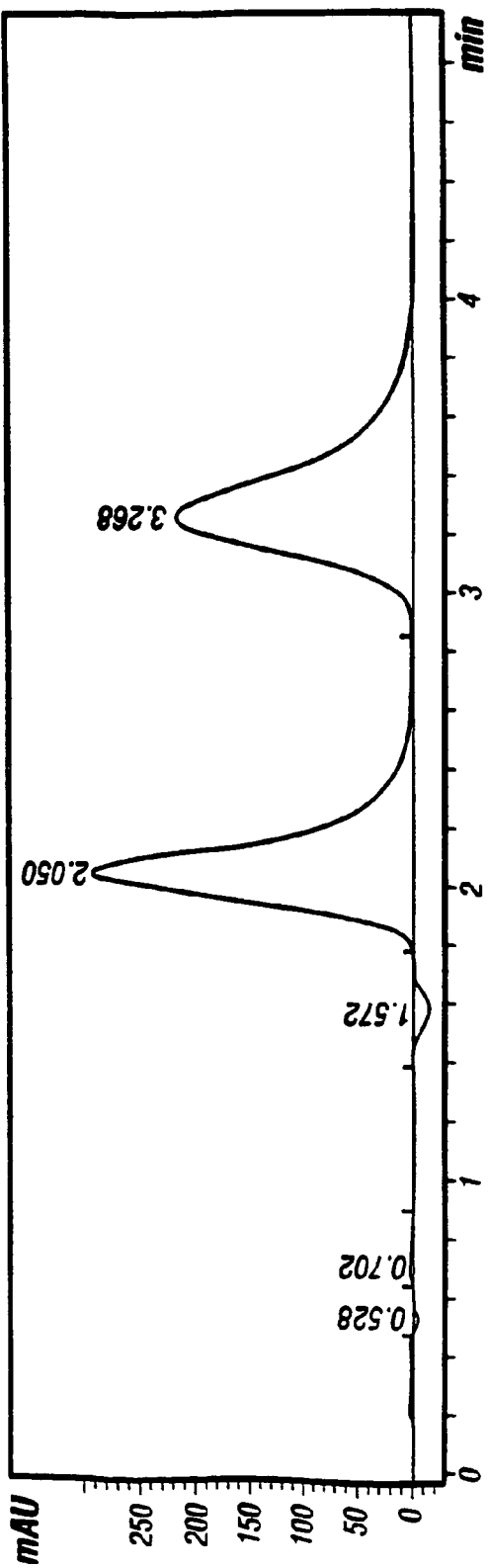
FIG. 11A
FIG. 11B

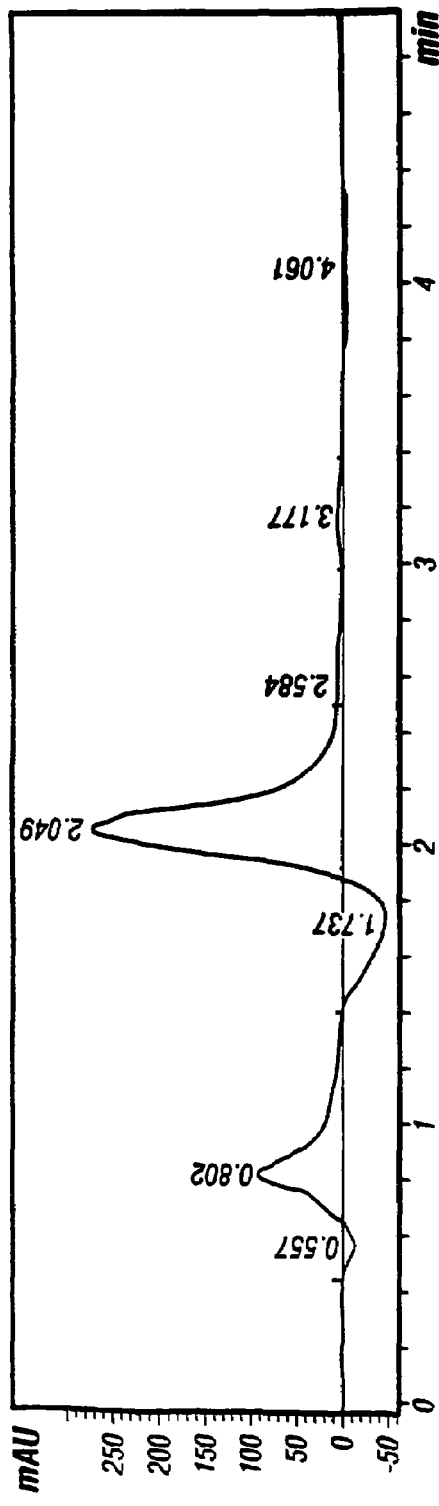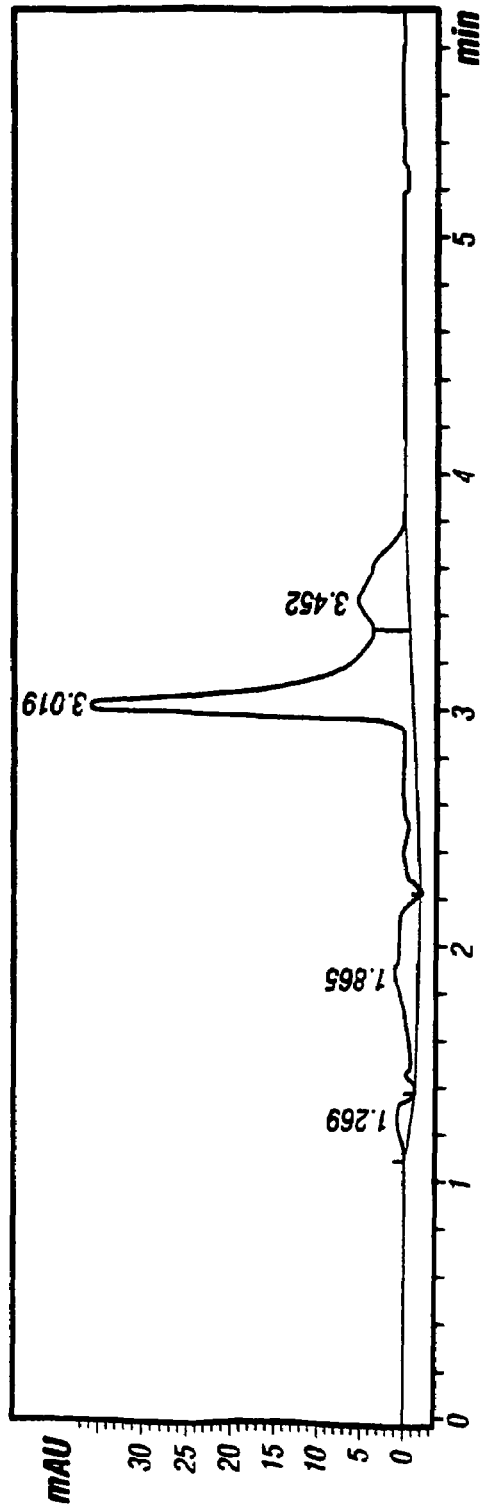

iminodiacetic acid

Pantenol

S-Plavix

EDTA

S-Ditropan

Cynomel

L-homophenyl alanine

Sarcosine alpha-methyl-L-tyrosine

Cuprimine/Depen

Diovan

Levothroid

Primaxin

L-Dopa

D-Dopa

D-alpha-methyl-DOPA

L-alpha-methyl-DOPA

L-gamma-hydroxy glutamate

D-gamma-hydroxy glutamate 3-(2-napthyl)-L-alanine

L-homoserine

D-homoserine

D-phenylglycine

L-phenylglycine

D-4-hydroxyl phenylglycine

L-4-hydroxyl-phenylglycine

D-tertiary leucine

Cefobid

D-isoleucine

L-tertiary leucine

L-isoleucine

L-norleucine

D-norleucine

L-norvaline

D-norvaline

Dexketoprofen

Fenoprofen

Flunoxaprofen

Ibuprofen

Loxoprofen

Pirprofen

Suprofen

Zaltoprofen alpha-methyl benzyl cyanide derivatives intermediate for Trocade 3-methyl-2-carboxy-piperidine Fospril 2-carboxy-cyclobutyl amine 2-carboxy-piperidine 2-carboxy-piperazine

NITRILASES, NUCLEIC ACIDS ENCODING THEM AND METHODS FOR MAKING AND USING THEM

CROSS-REFERENCES TO RELATED APPLICATIONS

This application claims the benefit of priority to U.S. patent application Ser. No. 10/241,742 (abandoned), filed Sep. 9, 2002, and U.S. Ser. No. 10/146,772, filed May 15, 2002, which claims the benefit of priority to U.S. Ser. No. 60/351,336, filed Jan. 22, 2002, U.S. Ser. No. 60/309,006, filed Jul. 30, 2001, and U.S. Ser. No. 60/300,189, filed Jun. 21, 2001; and is a continuation-in-part of U.S. Ser. No. 09/751,299, filed Dec. 28, 2000, now U.S. Pat. No. 7,300,775 which claims the benefit of priority to each of U.S. Ser. No. 60/254,414, filed Dec. 7, 2000, and U.S. Ser. No. 60/173,609, filed Dec. 29, 1999. These applications are hereby incorporated by reference into the subject application in their entireties for all purposes.

COPYRIGHT NOTIFICATION

Pursuant to 37 C.F.R. §1.71(e), a portion of this patent document contains material which is subject to copyright protection. The copyright owner has no objection to the facsimile reproduction by anyone of the patent document or the patent disclosure, as it appears in the Patent and Trademark Office patent file or records, but otherwise reserves all copyright rights whatsoever.

FIELD OF THE INVENTION

The invention relates generally to the field of molecular biology, biochemistry and chemistry, and particularly to enzymatic proteins having nitrilase activity. The invention also relates to polynucleotides encoding the enzymes, and to uses of such polynucleotides and enzymes.

BACKGROUND OF THE INVENTION

There are naturally occurring enzymes which have great potential for use in industrial chemical processes for the conversion of nitriles to a wide range of useful products and intermediates. Such enzymes include nitrilases which are capable of converting nitriles directly to carboxylic acids. Nitrilase enzymes are found in a wide range of mesophilic micro-organisms, including species of *Bacillus, Norcardia, Bacteridium, Rhodococcus*, micro-organisms, including species of *Bacillus, Norcardia, Bacteridium, Rhodococcus, Micrococcus, Brevibacterium, Alcaligenes, Acinetobacter, Corynebacterium, Fusarium* and *Klebsiella*. Additionally, there are thermophilic nitrilases which exist in bacteria.

There are two major routes from a nitrile to an analogous acid: (1) a nitrilase catalyzes the direct hydrolysis of a nitrile to a carboxylic acid with the concomitant release of ammonia; or (2) a nitrile hydratase adds a molecule of water across the carbon-nitrogen bonding system to give the corresponding amide, which can then act as a substrate for an amidase enzyme which hydrolyzes the carbon-nitrogen bond to give the carboxylic acid product with the concomitant release of ammonia. The nitrilase enzyme therefore provides the more direct route to the acid.

A nitrile group offers many advantages in devising synthetic routes in that it is often easily introduced into a molecular structure and can be carried through many processes as a masked acid or amide group. This is only of use, however, if the nitrile can be unmasked at the relevant step in the synthesis. Cyanide represents a widely applicable $C_1$-synthon (cyanide is one of the few water-stable carbanions) which can be employed for the synthesis of a carbon framework. However, further transformations of the nitrile thus obtained are impeded due to the harsh reaction conditions required for its hydrolysis using normal chemical synthesis procedures. The use of enzymes to catalyze the reactions of nitriles is attractive because nitrilase enzymes are able to effect reactions with fewer environmentally hazardous reagents and by-products than in many traditional chemical methods. Indeed, the chemoselective biocatalytic hydrolysis of nitrites represents a valuable alternative because it occurs at ambient temperature and near physiological pH.

The importance of asymmetric organic synthesis in drug design and discovery has fueled the search for new synthetic methods and chiral precursors which can be utilized in developing complex molecules of biological interest. One important class of chiral molecules is the α-substituted carboxylic acids, which include the α-amino acids. These molecules have long been recognized as important chiral precursors to a wide variety of complex biologically active molecules, and a great deal of research effort has been dedicated to the development of methods for the synthesis of enantiomerically pure α-amino acids and chiral medicines.

Of particular use to synthetic chemists who make chiral medicines would be an enzyme system which is useful under non-sterile conditions, which is useful in non-biological laboratories, which is available in a form convenient for storage and use; which has broad substrate specificity, which acts on poorly water soluble substrates; which has predictable product structure; which provides a choice of acid or amide product; and which is capable of chiral differentiation. Accordingly, there is a need for efficient, inexpensive, high-yield synthetic methods for producing enantiomerically pure α-substituted carboxylic acids, such as, for example, α-amino acids and α-hydroxy acids.

In addition, often, the discovery or evolution of an enzyme to perform a particular transformation can be aided by the availability of a convenient high throughput screening or selection process. While a surrogate substrate may be used when an effective ultra high throughput (UHTP) screen is not available, it may be desirable to screen directly for an enzyme that performs specifically the desired transformation. The challenges of designing an UHTP screen is evident when, for example, the discovery or evolution program is aimed at uncovering a stereoselective transformation to generate only one stereoisomer or enantiomer. In this case, there is a paucity of high throughput screening methods available. While, the most straightforward method is to use chiral liquid or gas phase separation to separate the two enantiomers in question, often this approach does not afford the very high throughput capacity that is required. By using mass spectroscopy (MS) techniques, very high throughput screens are possible. However, when applied in a conventional manner, MS does not afford information on chirality or enantioselectivity.

Another approach is to chemically derivatize the enantiomeric mixture with a single enantiomer compound, thus generating a diasteriomeric mixture of compounds that can be characterized by separation on an achiral stationary phase. Again, this is a cumbersome approach and does not lend itself well to high throughput screening.

Throughout this application, various publications are referenced by author and date. The disclosures of these publications in their entireties are hereby incorporated by reference into this application in order to more fully describe the state of

SUMMARY OF THE INVENTION

The present invention is directed to an isolated or recombinant nucleic acid comprising nucleotides having a sequence at least about 50% identical to SEQ ID NO: 1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, or variants thereof, wherein the nucleic acid encodes a polypeptide having a nitrilase activity. In alternative aspects of the invention, the nucleic acid comprises nucleotides having a sequence at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete identity (100% identical) to the SEQ ID NO: or variants thereof. Exemplary variants may include, for example, the following variations of SEQ ID NO:195, 205, 207, 209, OR 237, having one or more mutations: at positions 163-165 AAA, AAG, GGT, GGC, GGA, GGG, CAA, or CAG; at positions 178-180 GAA or GAG; at positions 331-333 TCT, TCC, TCA, TCG, AGT, or AGC; at positions 568-570 CAT, CAC, TCT, TCC, TCA, TCG, AGT, AGC, ACT, ACC, ACA, TCA, TAT, TAC, ATG or ACG; at positions 571-573 TTA, TTG, CTT, CTC, CTA, CTG, GTT, GTC, GTA, GTG, ATG, ACT, ACC, ACA, GAT, GAC, GGT, GGC, GGA, GGG, GAA, GAG, TAT, TAC, or ACG; at positions 595-597 GAA, GAG, TTA, TTG, CTT, CTC, CTA, or CTG; at positions 664-666 TTA, TTG, CTT, CTC, CTA, or CTG; or any combination thereof. In one aspect of the invention, the variants encode a polypeptide having improved or diminished enantioselectivity, for example, in the conversion of a 3-hydroxyglutarylnitrile (HGN) to (R)-4-Cyano-3-hydroxybutyrate, than the polypeptide encoded by the SEQ ID NO.

In one aspect of the invention, the nucleic acid comprises nucleotides having a sequence substantially identical to the SEQ ID NO: or variants thereof. In another aspect, the invention provides for an isolated or recombinant nucleic acid comprising consecutive nucleotides having a sequence at least 79% identical to SEQ ID NO: 33, wherein the nucleic acid encodes a polypeptide having nitrilase activity. The invention provides for a fragment of the nucleic acid, wherein the fragment encodes a polypeptide having nitrilase activity. The invention also provides for an isolated or recombinant nucleic acid complementary to any of the nucleic acids. The invention also provides for an isolated or recombinant nucleic acid that hybridizes to any one of the nucleic acids under stringent conditions. In one aspect, the stringent conditions comprise at least 50% formamide, and about 37° C. to about 42° C.

The invention provides for a nucleic acid probe comprising from about 15 nucleotides to about 10, 15, 20, 25, 30, 35, 40, 45, 50, 55, 60, 65, 70, 75, 80, 85, 90, 95, 100, 150, 200, 250, 300, 350, 400, 450, 500 or more nucleotides, wherein at least 10, 11, 12, 13, 14, 15, 16, 17, 18, 19, 20 or more consecutive nucleotides are at least 50% complementary to a nucleic acid target region within a nucleic acid sequence of SEQ ID NO: 1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, variants thereof, or their complements. In one aspect, the nucleic acid probe comprises consecutive nucleotides which are at least 55% complementary to the nucleic acid target region. In one aspect, the invention provides for a nucleic acid probe, wherein the consecutive nucleotides are at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or 100% complementary to the nucleic acid target region. In another aspect, the nucleic acid consists essentially of from about 20 to about 50 nucleotides. In other aspects, the nucleic acid can be at least about 20, 25, 30, 35, 40, 45, 50, 75, 100, 150 nucleotides in length.

The invention provides for a nucleic acid vector capable of replication in a host cell, wherein the vector comprises the nucleic acid of the invention. The invention also provides for a host cell comprising the nucleic acid. The invention also provides for a host organism comprising the host cell. In one aspect, the host organism comprises a gram negative bacterium, a gram positive bacterium or a eukaryotic organism. In another aspect, the gram negative bacterium comprises *Escherichia coli*, or *Pseudomonas fluorescens*. In a further aspect, the gram positive bacterium comprises *Streptomyces diversa, Lactobacillus gasseri, Lactococcus lactis, Lactococcus cremoris*, or *Bacillus subtilis*. In a further aspect, the eukaryotic organism comprises *Saccharomyces cerevisiae, Schizosaccharomyces pombe, Pichia pastoris, Kluyveromyces lactis, Hansenula plymorpha*, or *Aspergillus niger*.

The invention provides for an isolated or recombinant nucleic acid encoding a polypeptide comprising amino acids having a sequence at least 50% identical to SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, or variants thereof, wherein the polypeptide has nitrilase activity. In one aspect, the polypeptide comprises amino acids having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or 100% identity to the SEQ ID NO: or variants thereof. Exemplary variants may include, for example, the following variations of SEQ ID NO:196, 206, 208, 210 or 238, having one or more mutations: at residue 55 lysine, glycine, or glutamine; at residue 60 glutamic acid; at residue 111 serine, at residue 190, serine, histidine, tyrosine or threonine; at residue 191, leucine, valine, methionine, aspartic acid, glycine, glutamic acid, tyrosine or threonine; at residue 199 glutamic acid or leucine; at residue 222 leucine; or any combination thereof.

The invention also provides for an isolated or recombinant nucleic acid encoding a polypeptide comprising at least 10 consecutive amino acids having a sequence identical to a portion of an amino acid sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, or variants thereof.

An isolated or recombinant polypeptide comprising amino acids having a sequence at least about 50% identical to SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, or variants thereof, wherein the polypeptide has nitrilase activity. In one aspect of the invention, the polypeptide comprises amino acids having a sequence at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or 100% identical to the SEQ ID NO: or variants thereof.

The invention provides an isolated or recombinant nucleic acid comprising nucleotides having a sequence as set forth in any one of the following SEQ ID NOS:1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, and variants thereof (hereinafter referred to as "Group A nucleic acids"). The invention is also directed to nucleic acids having specified minimum percentages of sequence identity to any of the Group A nucleic acids sequences.

In another aspect, the invention provides an isolated (purified) or recombinant polypeptide comprising amino acid residues having a sequence as set forth in any one of the following SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, and variants thereof, (hereinafter referred to as "Group B amino acid sequences"). The invention is also directed to purified polypeptides having specified minimum percentages of sequence identity to any of the Group B amino acid sequences.

The invention provides for a fragment of the polypeptide which is at least 50 amino acids in length, and wherein the fragment has nitrilase activity. Furthermore, the invention provides for a peptidomimetic of the polypeptide or a fragment thereof having nitrilase activity. The invention provides for a codon-optimized polypeptide or a fragment thereof, having nitrilase activity, wherein the codon usage is optimized for a particular organism or cell. Narum et al. *Infect. Immun.* 2001 December, 69(12):7250-3 describes codon-optimization in the mouse system. Outchkourov et al. *Protein Expr. Purif.* 2002 February; 24(1):18-24 describes codon-optimization in the yeast system. Feng et al. *Biochemistry* 2000 Dec. 19, 39(50):15399-409 describes codon-optimization in *E. coli*. Humphreys et al. *Protein Expr. Purif.* 2000 November, 20(2):252-64 describes how codon usage affects secretion in *E. coli*.

In one aspect, the organism or cell comprises a gram negative bacterium, a gram positive bacterium or a eukaryotic organism. In another aspect of the invention, the gram negative bacterium comprises *Escherichia coli*, or *Pseudomonas fluorescens*. In another aspect of the invention, the gram positive bacterium comprise *Streptomyces diversa*, *Lactobacillus gasseri*, *Lactococcus lactis*, *Lactococcus cremoris*, or *Bacillus subtilis*. In another aspect of the invention, the eukaryotic organism comprises *Saccharomyces cerevisiae, Schizosaccharomyces pombe, Pichia pastoris, Kluyveromyces lactis, Hansenula plymorpha*, or *Aspergillus niger*.

In another aspect, the invention provides for a purified antibody that specifically binds to the polypeptide of the invention or a fragment thereof, having nitrilase activity. In one aspect, the invention provides for a fragment of the antibody that specifically binds to a polypeptide having nitrilase activity.

The invention provides for an enzyme preparation which comprises at least one of the polypeptides of the invention, wherein the preparation is liquid or dry. The enzyme preparation includes a buffer, cofactor, or second or additional protein. In one aspect the preparation is affixed to a solid support. In one aspect of the invention, the solid support can be a gel, a resin, a polymer, a ceramic, a glass, a microelectrode and any combination thereof. In another aspect, the preparation can be encapsulated in a gel or a bead.

The invention further provides for a composition which comprises at least one nucleic acid of the invention which comprises at least one polypeptide of the invention or a fragment thereof, or a peptidomimetic thereof, having nitrilase activity, or any combination thereof.

The invention provides for a method for hydrolyzing a nitrile to a carboxylic acid comprising contacting the molecule with at least one polypeptide of the invention or a fragment thereof, or a peptidomimetic thereof, having nitrilase activity, under conditions suitable for nitrilase activity. In one aspect, the conditions comprise aqueous conditions. In another aspect, the conditions comprise a pH of about 8.0 and/or a temperature from about 37° C. to about 45° C.

The invention provides for a method for hydrolyzing a cyanohydrin moiety or an aminonitrile moiety of a molecule, the method comprising contacting the molecule with at least one polypeptide of the invention, or a fragment thereof, or a peptidomimetic thereof, having nitrilase activity, under conditions suitable for nitrilase activity.

The invention provides for a method for making a chiral α-hydroxy acid molecule, a chiral amino acid molecule, a chiral β-hydroxy acid molecule, or a chiral gamma-hydroxy acid molecule, the method comprising admixing a molecule having a cyanohydrin moiety or an aminonitrile moiety with at least one polypeptide having an amino acid sequence at least 50% identical to any one of the Group B amino acid sequences or a fragment thereof, or a peptidomimetic thereof, having enantio-selective nitrilase activity. In one aspect, the chiral molecule is an (R)-enantiomer. In another aspect, the chiral molecule is an (S)-enantiomer. In one aspect of the invention, one particular enzyme can have R-specificity for one particular substrate and the same enzyme can have S-specificity for a different particular substrate.

The invention also provides for a method for making a composition or an intermediate thereof, the method comprising admixing a precursor of the composition or intermediate, wherein the precursor comprises a cyanohydrin moiety or an aminonitrile moiety, with at least one polypeptide of the invention or a fragment or peptidomimetic thereof having nitrilase activity, hydrolyzing the cyanohydrin or the aminonitrile moiety in the precursor thereby making the composition or the intermediate thereof. In one aspect, the composition or intermediate thereof comprises (S)-2-amino-4-phenyl butanoic acid. In a further aspect, the composition or intermediate thereof comprises an L-amino acid. In a further aspect, the composition comprises a food additive or a pharmaceutical drug.

The invention provides for a method for making an (R)-ethyl 4-cyano-3-hydroxybutyric acid, the method comprising contacting a hydroxyglutaryl nitrile with at least one polypeptide having an amino acid sequence of the Group B amino acid sequences, or a fragment or peptidomimetic thereof having nitrilase activity that selectively produces an (R)-enantiomer, so as to make (R)-ethyl 4-cyano-3-hydroxybutyric acid. In one aspect, the ee is at least 95% or at least 99%. In another aspect, the hydroxyglutaryl nitrile comprises 1,3-dicyano-2-hydroxy-propane or 3-hydroxyglutaronitrile. In a further aspect, the polypeptide has an amino acid sequence of any one of the Group B amino acid sequences, or a fragment or peptidomimetic thereof having nitrilase activity.

The invention also provides a method for making an (S)-ethyl 4-cyano-3-hydroxybutyric acid, the method comprising contacting a hydroxyglutaryl nitrile with at least one polypeptide having an amino acid sequence of the Group B amino acid sequences, or a fragment or peptidomimetic thereof having nitrilase activity that selectively produces an (S)-enantiomer, so as to make (S)-ethyl 4-cyano-3-hydroxybutyric acid.

The invention provides a method for making an (R)-mandelic acid, the method comprising admixing a mandelonitrile with at least one polypeptide having an amino acid sequence of any one of the Group B amino acid sequences or any fragment or peptidomimetic thereof having appropriate nitrilase activity. In one aspect, the (R)-mandelic acid comprises (R)-2-chloromandelic acid. In another aspect, the (R)-mandelic acid comprises an aromatic ring substitution in the ortho-, meta-, or para-positions; a 1-naphthyl derivative of (R)-mandelic acid, a pyridyl derivative of (R)-mandelic acid or a thienyl derivative of (R)-mandelic acid or a combination thereof.

The invention provides a method for making an (S)-mandelic acid, the method comprising admixing a mandelonitrile with at least one polypeptide having an amino acid sequence of Group B sequences or any fragment or peptidomimetic thereof having nitrilase activity. In one aspect, the (S)-mandelic acid comprises (S)-methyl benzyl cyanide and the mandelonitrile comprises (S)-methoxy-benzyl cyanide. In one aspect, the (S)-mandelic acid comprises an aromatic ring substitution in the ortho-, meta-, or para-positions; a 1-naphthyl derivative of (S)-mandelic acid, a pyridyl derivative of (S)-mandelic acid or a thienyl derivative of (S)-mandelic acid or a combination thereof.

The invention also provides a method for making an (S)-phenyl lactic acid derivative or an (R)-phenyllacetic acid derivative, the method comprising admixing a phenyllactonitrile with at least one polypeptide selected from the group of the Group B amino acid sequences or any active fragment or peptidomimetic thereof that selectively produces an (S)-enantiomer or an (R)-enantiomer, thereby producing an (S)-phenyl lactic acid derivative or an (R)-phenyl lactic acid derivative.

The invention provides for a method for making the polypeptide of the invention or a fragment thereof, the method comprising (a) introducing a nucleic acid encoding the polypeptide into a host cell under conditions that permit production of the polypeptide by the host cell, and (b) recovering the polypeptide so produced.

The invention provides for a method for generating a nucleic acid variant encoding a polypeptide having nitrilase activity, wherein the variant has an altered biological activity from that which naturally occurs, the method comprising (a) modifying the nucleic acid by (i) substituting one or more nucleotides for a different nucleotide, wherein the nucleotide comprises a natural or non-natural nucleotide; (ii) deleting one or more nucleotides, (iii) adding one or more nucleotides, or (iv) any combination thereof. In one aspect, the non-natural nucleotide comprises inosine. In another aspect, the method further comprises assaying the polypeptides encoded by the modified nucleic acids for altered nitrilase activity, thereby identifying the modified nucleic acid(s) encoding a polypeptide having altered nitrilase activity. In one aspect, the modifications of step (a) are made by PCR, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis, ligase chain reaction, in vitro mutagenesis, ligase chain reaction, oligonucleotide synthesis, any DNA-generating technique and any combination thereof. In another aspect, the method further comprises at least one repetition of the modification of step (a).

The invention further provides a method for making a polynucleotide from two or more nucleic acids, the method comprising: (a) identifying regions of identity and regions of diversity between two or more nucleic acids, wherein at least one of the nucleic acids comprises a nucleic acid of the invention; (b) providing a set of oligonucleotides which correspond in sequence to at least two of the two or more nucleic acids; and, (c) extending the oligonucleotides with a polymerase, thereby making the polynucleotide.

The invention further provides a screening assay for identifying a nitrilase, the assay comprising: (a) providing a plurality of nucleic acids or polypeptides comprising at least one of the nucleic acids of the invention, or at least one of the polypeptides of the invention; (b) obtaining polypeptide candidates to be tested for nitrilase activity from the plurality; (c) testing the candidates for nitrilase activity; and (d) identifying those polypeptide candidates which are nitrilases. In one aspect, the method further comprises modifying at least one of the nucleic acids or polypeptides prior to testing the candidates for nitrilase activity. In another aspect, the testing of step (c) further comprises testing for improved expression of the polypeptide in a host cell or host organism. In a further aspect, the testing of step (c) further comprises testing for nitrilase activity within a pH range from about pH 3 to about pH 12. In a further aspect, the testing of step (c) further comprises testing for nitrilase activity within a pH range from about pH 5 to about pH 10. In another aspect, the testing of step (c) further comprises testing for nitrilase activity within a temperature range from about 4° C. to about 80° C. In another aspect, the testing of step (c) further comprises testing for nitrilase activity within a temperature range from about 4° C. to about 55° C. In another aspect, the testing of step (c) further comprises testing for nitrilase activity which results in an enantioselective reaction product. In another aspect, the testing of step (c) further testing for nitrilase activity which results in a regio-selective reaction product.

The invention provides for use of the nucleic acids of the invention, or a fragment or peptidomimetic thereof having nitrilase activity, in a process designed to optimize one aspect of the gene or one aspect of the polypeptide encoded by the gene. In one aspect, the process comprises introducing modifications into the nucleotide sequence of the nucleic acid. In another aspect, the modifications are introduced by PCR, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis, ligase chain reaction, in vitro mutagenesis, ligase chain reaction, oligonucleotide synthesis, any other DNA-generating technique or any combination thereof. In a further aspect, the process is repeated.

The invention provides for use of the polypeptide of the invention, or a fragment or peptidominetic thereof having nitrilase activity, in an industrial process. In one aspect, the process is for production of a pharmaceutical composition, the process is for production of a chemical, the process is for production of a food additive, the process is catalyzing the breakdown of waste, or the process is production of a drug intermediate. In a further aspect, the process comprises use of the polypeptide to hydrolyze a hydroxyglutarylnitrile substrate. In a further aspect, the process is for production of LIPITOR™. In another aspect, the polypeptide used comprises a polypeptide having consecutive amino acids of the sequence SEQ ID NO:44, 196, 208, 210, or 238 or a fragment thereof having nitrilase activity. In another aspect, the process is production of a detergent. In another aspect, the process is production of a food product.

The invention provides for use of a nucleic acid of the invention, or a fragment thereof encoding a polypeptide having nitrilase activity, in the preparation of a transgenic organism.

The invention provides for a kit comprising (a) the nucleic acid of the inventions, or a fragment thereof encoding a polypeptide having nitrilase activity, or (b) the polypeptide of the invention, or a fragment or a peptidomimetic thereof having nitrilase activity, or a combination thereof; and (c) a buffer.

The invention provides for a method for modifying a molecule comprising: (a) mixing a polypeptide of the invention or a fragment or peptidomimetic thereof having nitrilase activity, with a starting molecule to produce a reaction mixture; (b) reacting the starting molecule with the polypeptide to produce the modified molecule.

The invention provides for a method for identifying a modified compound comprising: (a) admixing a polypeptide of the invention, or a fragment or peptidomimetic thereof having nitrilase activity, with a starting compound to produce a reaction mixture and thereafter a library of modified starting compounds; (b) testing the library to determine whether a modified starting compound is present within the library which exhibits a desired activity; (c) identifying the modified compound exhibiting the desired activity.

The invention provides a screening assay for enantioselective transformation comprising: (a) providing a molecule having two prochiral or enantiotopic moieties; (b) labeling at least one prochiral or enantiotopic moiety of the molecule; (b) modifying at least one of the two moieties by a selective catalyst; and (c) detecting results by mass spectroscopy. The screening assay can be used to determine or monitor the % enantiomeric excess (ee) or determine the % diasteromeric excess (de). An exemplary label useful in the assay is a heavier isotope or a liter isotope. The selective catalyst useful in the assay can be an enzyme. The screening assay may be performed with both moieties labeled. The screening assay may be performed in both directions, i.e., from the reactants to the products as well as from the products to the reactants.

The invention provides for a computer readable medium having stored thereon a nucleic acid of the invention, e.g., a nucleic acid comprising at least one nucleotide sequence selected from the group consisting of: SEQ ID NO: 1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, and variants thereof, and/or at least one amino acid sequence selected from the group consisting of: SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, and variants thereof.

The invention provides for a computer system comprising a processor and a data storage device, wherein the data storage device has stored thereon a nucleic acid of the invention, e.g., a nucleic acid comprising at least one nucleotide sequence selected from the group consisting of SEQ ID NO: 1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, and variants thereof, and/or at least one amino acid sequence selected from the group consisting of: SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, and variants thereof. In one aspect, the computer system further comprises a sequence comparison algorithm and a data storage device having at least one reference sequence stored thereon. In another aspect, the sequence comparison algorithm comprises a computer program that identifies polymorphisms.

The invention provides for a method for identifying a feature in a sequence which comprises: (a) inputting the sequence into a computer; (b) running a sequence feature identification program on the computer so as to identify a feature within the sequence; and (c) identifying the feature in the sequence, wherein the sequence comprises a nucleic acid of the invention, e.g., a nucleic acid comprising at least one of SEQ ID NOS:1-386, its variants, or any combination thereof.

The invention provides for an assay for identifying a functional fragment of a polypeptide which comprises: (a) obtaining a fragment of at least one polypeptide of the invention; (b) contacting at least one fragment from step (a) with a substrate having a cyanohydrin moiety or an aminonitrile moiety under reaction conditions suitable for nitrilase activity; (c) measuring the amount of reaction product produced by each at least one fragment from step (b); and (d) identifying the at least one fragment which is capable of producing a nitrilase reaction product; thereby identifying a functional fragment of the polypeptide. In one aspect, the fragment of step (a) is obtained by synthesizing the fragment. In another aspect, the fragment of step (a) is obtained by fragmenting the polypeptides.

The invention provides for an assay for identifying a functional variant of a polypeptide which comprises: (a) obtaining at least one variant of at least one polypeptide of the invention; (b) contacting at least one variant from step (a) with a substrate having a cyanohydrin moiety or an aminonitrile moiety under reaction conditions suitable for nitrilase activity; (c) measuring the amount of reaction product produced by each at least one variant from step (b); and (d) identifying the at least one variant which is capable of producing a nitrilase reaction product; thereby identifying a functional variant of the polypeptide.

BRIEF DESCRIPTION OF THE DRAWINGS

FIGS. 7A-7E illustrate chromatograms which are characteristic of substrate and product combinations for (R)-2-chloromandelic acid. FIG. 7A shows only 2-chloromandelonitrile in buffer; FIG. 7B shows a cloromandelic acid standard. The chromatogram in FIG. 7C shows the appearance of product and the reduction of substrate peaks.

FIGS. 8A-8B illustrate chromatograms characteristic of substrate and product combinations for (S)-phenyllacetic acid.

FIGS. 9A-9B illustrate chromatograms characteristic of substrate and product combinations for L-2-methylphenylglycine.

FIGS. 10A-10C illustrate chromatograms characteristic of substrate and product combinations for L-tert-leucine.

FIGS. 11A-11C illustrate chromatograms characteristic of substrate and product combinations for (S)-2-amino-6-hydroxy hexanoic acid.

FIGS. 12A-12D illustrate chromatograms characteristic of substrate and product combinations for 4-methyl-D-leucine and 4-methyl-L-leucine.

DETAILED DESCRIPTION OF THE INVENTION

The present invention relates to nitrilases, nucleic acids encoding nitrilases, and uses therefor. As used herein, the term "nitrilase" encompasses any polypeptide having any nitrilase activity, for example, the ability to hydrolyze nitrites into their corresponding carboxylic acids and ammonia. Nitrilases have commercial utility as biocatalysts for use in the synthesis of enantioselective aromatic and aliphatic amino acids or hydroxy acids.

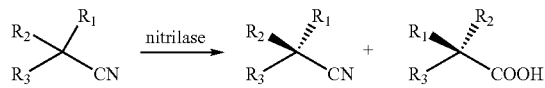

Nitrilase chemistry is as follows:

A nitrilase reaction for the preparation of hydroxy acids is as follows:

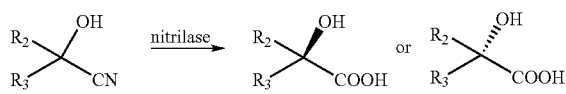

A nitrilase reaction for the preparation of amino acids is as follows:

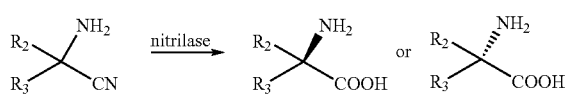

In addition, in each of the foregoing hydrolysis reactions, two water molecules are consumed and one ammonia molecule is released.

Figure 1:
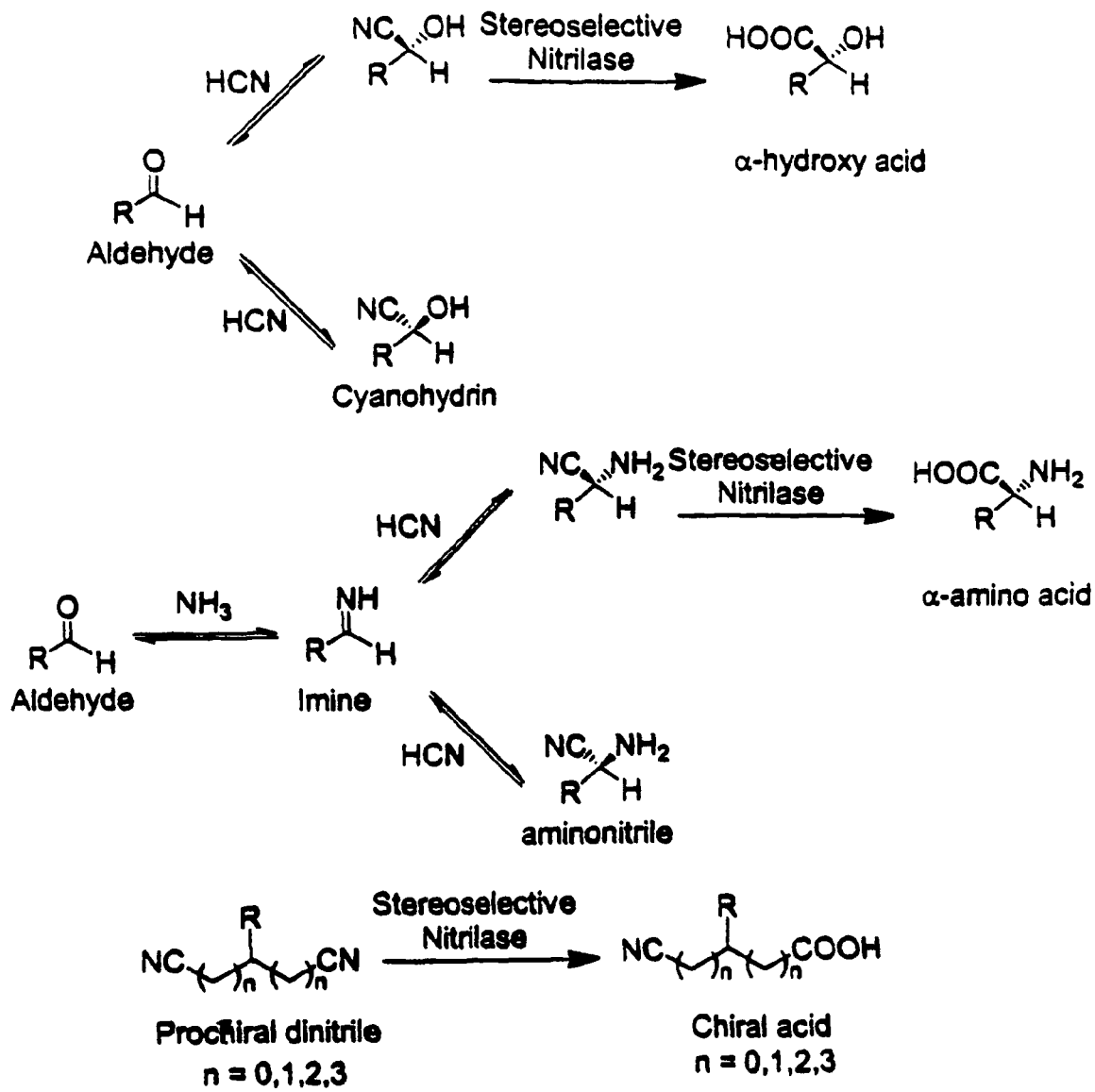
FIG. 1 shows chemical reaction schemes wherein stereoselective nitrilases hydrolyze a cyanohydrin or an aminonitrile to produce a chiral α-hydroxy acid or α-amino acid.
Figure 2:
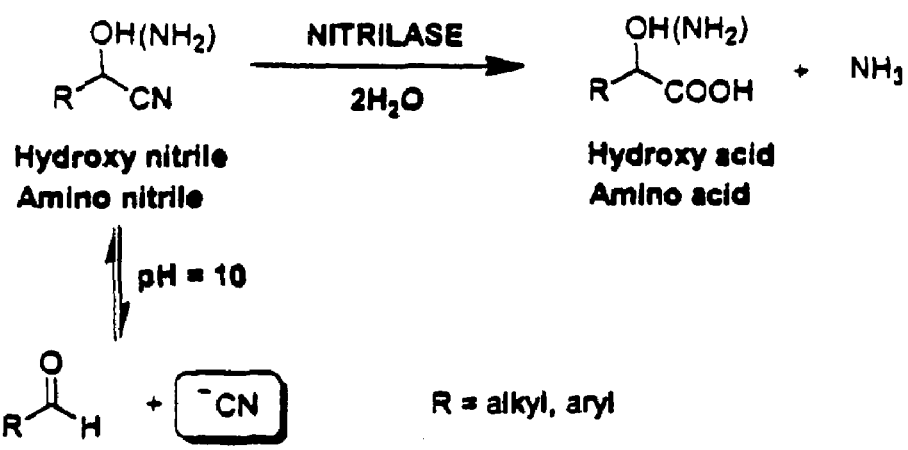
FIG. 2 illustrates an OPA based cyanide detection assay used for identifying the presence of nitrilase activity.
Figure 2:
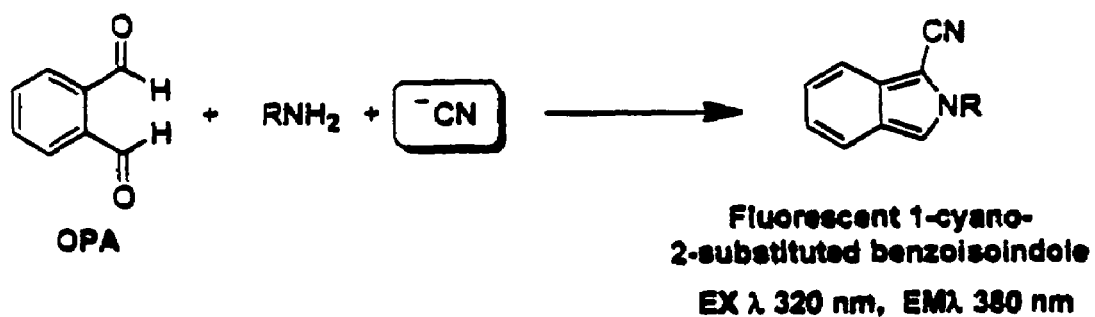
Figure 3:
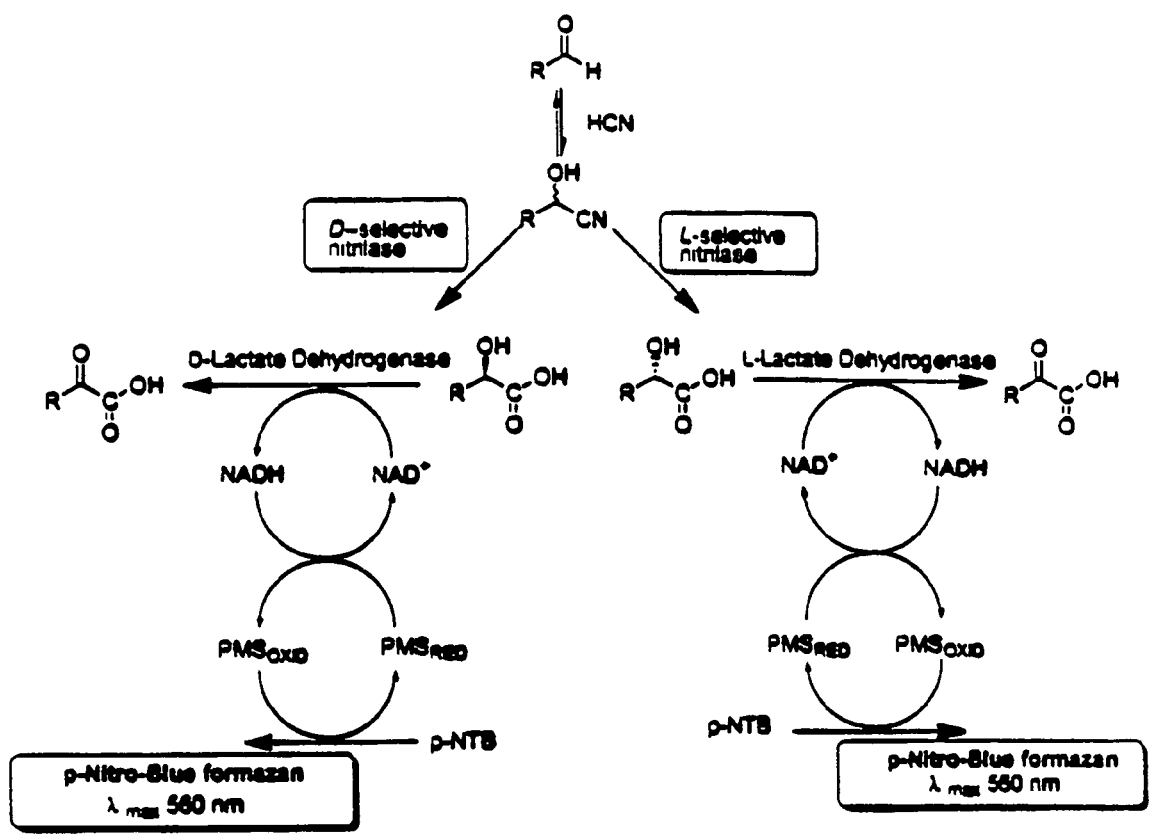
FIG. 3 is an illustration of a spectroscopic system for the detection and quantification of α-hydroxy acids based on stereoselective lactate dehydrogenases.
Figure 4:
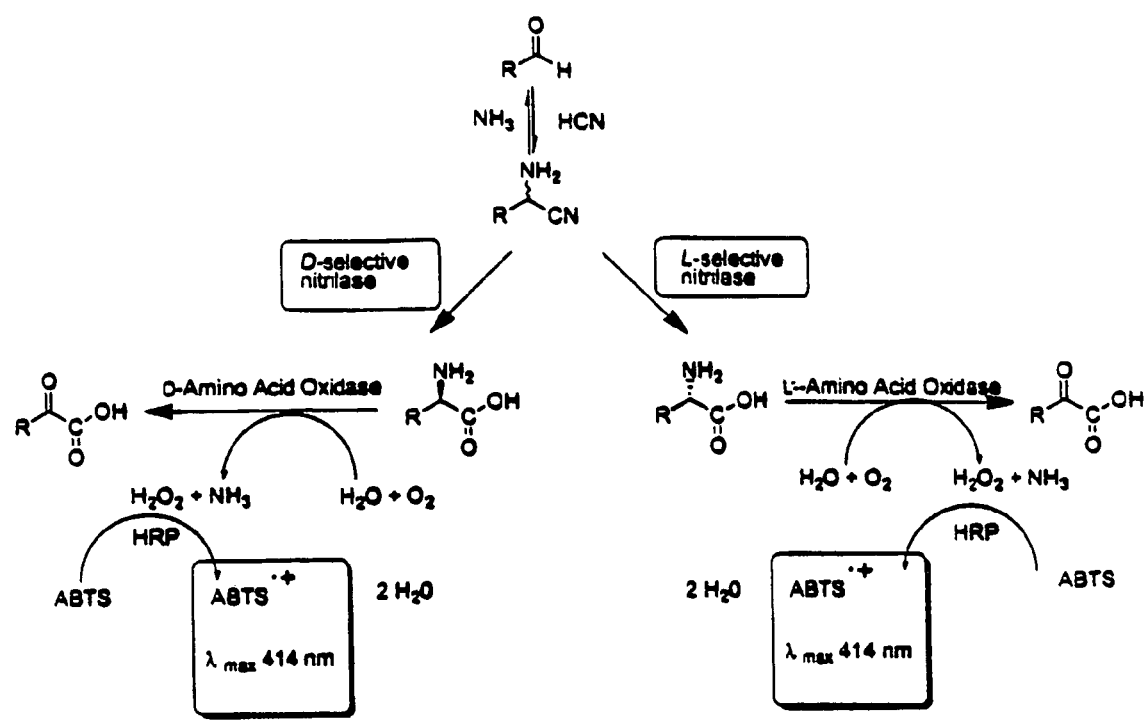
FIG. 4 is an illustration of a spectroscopic system for the detection and quantification of α-amino acids based on stereoselective amino acid oxidase.

There are several different types of assays which can be performed to test for the presence of nitrilase activity in a sample or to test whether a particular polypeptide exhibits nitrilase activity. For example, assays can detect the presence or absence of products or by-products from a chemical reaction catalyzed by a nitrilase. For example, the presence of nitrilase activity can be detected by the production of α-hydroxy acids or α-amino acids from, respectively, cyanohydrins or aminonitriles, and the level of nitrilase activity can be quantified by measuring the relative quantities of the reaction products produced. FIG. 1 shows chemical reaction schemes using stereoselective nitrilases to create chiral α-hydroxy acids or α-amino acids in high yield. The starting material is an aldehyde or an imine which is produced from an aldehyde by reaction with ammonia. Reaction of the aldehyde or imine with hydrogen cyanide results in the production of enantiomeric mixtures of the corresponding cyanohydrins and aminonitriles. A stereoselective nitrilase can then be used to stereoselectively convert one enantiomer into the corresponding α-hydroxy acid or α-amino acid. FIG. 3 illustrates schematically the stereoselective nitrilase-dependent production and spectrophotometric detection of α-hydroxy acids based on lactate dehydrogenase conversion of the α-hydroxy acids to the corresponding α-keto acids and concomitant oxidation-reduction of a detectable dye. FIG. 4 illustrates schematically the stereoselective nitrilase-dependent production and spectrophotometric detection of α-amino acids based on amino acid oxidase conversion of the α-amino acids to the corresponding α-keto acids and concomitant oxidation-reduction of a detectable dye.

Nitrilases contemplated for use in the practice of the present invention include those which stereoselectively hydrolyze nitriles or cyanohydrins into their corresponding acids and ammonia. In one aspect, nitrilases of the invention can stereoselectively hydrolyze nitrites or cyanohydrins into their corresponding acids and ammonia. Nitrilases include, for example, nitrilases of the invention, e.g., those set forth in the Group B amino acid sequences. Some nitrilases which stereoselectively hydrolyze their substrates are set forth in the Tables hereinbelow.

The nitrilases of the invention share the following additional characteristics:

(1) full-length amino acid sequences from about 333 amino acids to about 366 amino acids, (2) aggregation and activity as homo-multimers of about 2 subunits to about 16 subunits, (3) presence of a catalytic triad of the consecutive amino acids Glu-Lys-Cys, (4) pH optima from about pH 5 to about pH 9, and (5) temperature optima from about 0° C. to about 100° C., or from about 40° C. to about 50° C.

Consensus Sequences Among New Nitrilases

The nitrilases disclosed herein were studied using bioinformatics and sequence comparison programs and the following consensus information was collected. Three regions of conserved motifs were identified within the nitrilase polypeptides. These correspond to the catalytic triad (E-K-C) present in nitrilase enzymes. (H. Pace and C. Brenner (Jan. 15, 2001) "The Nitrilase Superfamily: classification, structure and function" Genome Biology Vol. 2, No. 1, pp 1-9.)

The abbreviations used herein are conventional one letter codes for the amino acids: A, alanine; B, asparagine or aspartic acid; C, cysteine; D aspartic acid; E, glutamate, glutamic acid; F, phenylalanine; G, glycine; H histidine; I isoleucine; K, lysine; L, leucine; M, methionine; N, asparagine; P, proline; Q, glutamine; R, arginine; S, serine; T, threonine; V, valine; W, tryptophan; Y, tyrosine; Z, glutamine or glutamic acid. See L. Stryer, Biochemistry, 1988, W. H. Freeman and Company, New York.

The computer sequence comparisons made among the nitrilase polypeptide sequences of the invention resulted in the identification of these motifs within each amino acid sequence:

| F | P | E | t | f | | r | R | K | L | . | P | T | | L | . | C | W | E | h | . | . | P |
|---|---|---|---|---|---|---|---|---|---|---|---|---|---|---|---|---|---|---|---|---|---|---|

The following residues (those that are underlined) are completely conserved among all of the identified nitrilases: the third amino acid in the first motif or region (E, glutamate); the second residue in the second motif (R, arginine); the third residue in the second motif (K, lysine); the third residue in the third motif (C, cysteine); and the fifth residue in the third motif (E, glutamate).

In the boxes, upper case letters indicate 90% or greater consensus among the nitrilases of the invention, while lower case letters indicate 50% or greater consensus. An italicized letter indicates 30% or greater consensus among the nitrilases of the invention. A dot in a box indicates a residue which is not conserved.

The sequences of nitrilases in the nitrilase branch of the nitrilase superfamily were described as having a catalytic triad in the Pace and Brenner article (Genome Biology, 2001, Vol. 2, No. 1, pp. 1-9). However, the catalytic triad regions of the nitrilases of this invention differ from those previously identified in the Pace and Brenner reference in the following ways:

Differences in the first motif: The F in the first box of the first motif is conserved in 90% of the nitrilases of the invention, rather than in only 50% of those previously identified. The fourth residue of the first motif is a "t", threonine in the nitrilases of this invention, and it is found at 50% or greater consensus. However, that residue was identified by Pace and Brenner as "a" (alanine). The last residue of the first motif was identified as "f" (phenylalanine) and was indicated to occur at 50% or greater consensus. However, the nitrilases of this invention only show "f" (phenylalanine occurring at 30% consensus.

Differences in the second motif: There is an "r" (arginine) in the first box of the second motif of the nitrilases of this invention. However, the Pace and Brenner consensus shows an "h" (histidine) in that position. The "R" (arginine) in the second box is completely conserved in the nitrilases of the present invention, however that residue only appears at 90% consensus in the Pace and Brenner reference. The "L" (leucine) in the fourth box of the second motif is conserved in 90% or more of the nitrilases of this invention. However, the Pace and Brenner nitrilases only showed conservation of that residue in 50% of the sequences. Similarly, the "P" (proline) at the sixth box of the second motif is conserved in 90% or more of the nitrilases of this invention. However, the Pace and Brenner nitrilases only showed conservation of that residue in 50% of the sequences.

Differences in the third motif: The "L in the first box is conserved at 90% or greater in the nitrilases of the invention. However, the Pace and Brenner reference only shows that residue appearing 50% of the time. Finally, the sixth box in the third motif in the nitrilases of the invention show a histidine 50% of the time or more. However, the Pace and Brenner reference indicates that that position shows an asparagine ("n") 50% of the time.

The invention provides for an isolated polypeptide having nitrilase activity which polypeptide comprises three regions, wherein the first region comprises five amino acids and wherein the first amino acid of the first region is F and the fourth amino acid of the first region is T. The invention also provides for an isolated polypeptide having nitrilase activity which polypeptide comprises three regions, wherein the second region comprises seven amino acids and wherein the first amino acid of the second region is R, wherein the second amino acid of the second region is R, and wherein the sixth amino acid of the second region is P. The invention also provides for an isolated polypeptide having nitrilase activity which polypeptide comprises three regions, wherein the third region comprises nine amino acids and wherein the first amino acid of the third region is L and the sixth amino acid of the third region is H.

The invention also provides for an isolated polypeptide having nitrilase activity which polypeptide comprises three consenus subsequences, wherein the first consensus subsequence is FPETF, wherein the second consensus subsequence is RRKLXPT, and wherein the third consensus subsequence is LXCWEHXXP.

The invention also provides for an isolated polypeptide having nitrilase activity which polypeptide comprises three consenus subsequences, wherein the first consensus subsequence is FPEXX, wherein the second consensus subsequence is XRKLXPT, and wherein the third consensus subsequence is LXCWEXXXP.

In accordance with the present invention, methods are provided for producing enantiomerically pure α-substituted carboxylic acids. The enantiomerically pure α-substituted carboxylic acids produced by the methods of the present invention have the following structure:

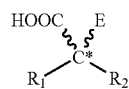

wherein:

$R_1 \neq R_2$ and $R_1$ and $R_2$ are otherwise independently —H, substituted or unsubstituted alkyl, alkenyl, alkynyl, aryl, heteroaryl, cycloalkyl, or heterocyclic, wherein said substituents are lower alkyl, hydroxy, alkoxy, amino, mercapto, cycloalkyl, heterocyclic, aryl, heteroaryl, aryloxy, or halogen or optionally $R_1$ and $R_2$ are directly or indirectly covalently joined to form a functional cyclic moiety, and E is —N($R_x$)$_2$ or —OH, wherein each $R_x$ is independently —H or lower alkyl.

As used herein, the term "alkyl" refers to straight or branched chain or cyclic hydrocarbon groups of from 1 to 24 carbon atoms, including methyl, ethyl, n-propyl, isopropyl, n-butyl, isobutyl, tert-butyl, n-pentyl, n-hexyl, and the like. The term "lower alkyl" refers to monovalent straight or branched chain or cyclic radicals of from one to about six carbon atoms.

As used herein, "alkenyl" refers to straight or branched chain or cyclic hydrocarbon groups having one or more carbon-carbon double bonds, and having in the range of about 2 to about 24 carbon atoms.

As used herein, "alkynyl" refers to straight or branched chain or cyclic hydrocarbon groups having at least one carbon-carbon triple bond, and having in the range of about 2 to about 24 carbon atoms.

As used herein, "cycloalkyl" refers to cyclic hydrocarbon groups containing in the range of about 3 to about 14 carbon atoms.

As used herein, "heterocyclic" refers to cyclic groups containing one or more heteroatoms (e.g., N, O, S, P, Se, B, etc.) as part of the ring structure, and having in the range of about 3 to about 14 carbon atoms.

As used herein, "aryl" refers to aromatic groups (i.e., cyclic groups with conjugated double-bond systems) having in the range of about 6 to about 14 carbon atoms.

As used herein with respect to a chemical group or moiety, the term "substituted" refers to such a group or moiety further bearing one or more non-hydrogen substituents. Examples of such substituents include, without limitation, oxy (e.g., in a ketone, aldehyde, ether, or ester), hydroxy, alkoxy (of a lower alkyl group), amino, thio, mercapto (of a lower alkyl group), cycloalkyl, substituted cycloalkyl, heterocyclic, substituted heterocyclic, aryl, substituted aryl, heteroaryl, substituted heteroaryl, aryloxy, substituted aryloxy, halogen, trifluoromethyl, cyano, nitro, nitrone, amino, amido, —C(O)H, acyl, oxyacyl, carboxyl, carbamate, sulfonyl, sulfonamide, sulfuryl, and the like.

In preferred aspects, the enantiomerically pure α-substituted carboxylic acid produced by the methods of the present invention is an α-amino acid or α-hydroxy acid. In some aspects, the enantiomerically pure α-amino acid is D-phenylalanine, D-phenylglycine, L-methylphenylglycine, L-tert-leucine, D-alanine, or D-hydroxynorleucine ((S)-2-amino-6-hydroxy hexanoic acid), R-pantolactone, 2-chloromandelic acid, or (S)- or (R)-mandelic acid and the enantiomerically pure α-hydroxy acid is (S)-cyclohexylnandelic acid. As used herein, a "small molecule" encompasses any molecule having a molecular weight from at least 25 Daltons.

The term "about" is used herein to mean approximately, roughly, around, or in the region of. When the term "about" is used in conjunction with a numerical range, it modifies that range by extending the boundaries above and below the numerical values set forth. In general, the term "about" is used herein to modify a numerical value above and below the stated value by a variance of 20 percent up or down (higher or lower).

As used herein, the word "or" means any one member of a particular list and also includes any combination of members of that list.

The phrase "nucleic acid" as used herein refers to a naturally occurring or synthetic oligonucleotide or polynucleotide, whether DNA or RNA or DNA-RNA hybrid, single-stranded or double-stranded, sense or antisense, which is capable of hybridization to a complementary nucleic acid by Watson-Crick base-pairing. Nucleic acids of the invention can also include nucleotide analogs (e.g., BrdU), and non-phosphodiester internucleoside linkages (e.g., peptide nucleic acid (PNA) or thiodiester linkages). In particular, nucleic acids can include, without limitation, DNA, RNA, cDNA, GDNA, ssDNA or dsDNA or any combination thereof. In some aspects, a "nucleic acid" of the invention includes, for example, a nucleic acid encoding a polypeptide as set forth in the Group B amino acid sequences, and variants thereof. The phrase "a nucleic acid sequence" as used herein refers to a consecutive list of abbreviations, letters, characters or words, which represent nucleotides. In one aspect, a nucleic acid can be a "probe" which is a relatively short nucleic acid, usually less than 100 nucleotides in length. Often a nucleic acid probe is from about 50 nucleotides in length to about 10 nucleotides in length. A "target region" of a nucleic acid is a portion of a nucleic acid that is identified to be of interest.

A "coding region" of a nucleic acid is the portion of the nucleic acid which is transcribed and translated in a sequence-specific manner to produce into a particular polypeptide or protein when placed under the control of appropriate regulatory sequences. The coding region is said to encode such a polypeptide or protein.

The term "gene" refers to a coding region operably joined to appropriate regulatory sequences capable of regulating the expression of the polypeptide in some manner. A gene includes untranslated regulatory regions of DNA (e.g., promoters, enhancers, repressors, etc.) preceding (upstream) and following (downstream) the coding region (open reading frame, ORF) as well as, where applicable, intervening sequences (i.e., introns) between individual coding regions (i.e., exons).

"Polypeptide" as used herein refers to any peptide, oligopeptide, polypeptide, gene product, expression product, or protein. A polypeptide is comprised of consecutive amino acids. The term "polypeptide" encompasses naturally occurring or synthetic molecules.

In addition, as used herein, the term "polypeptide" refers to amino acids joined to each other by peptide bonds or modified peptide bonds, e.g., peptide isosteres, and may contain modified amino acids other than the 20 gene-encoded amino acids. The polypeptides can be modified by either natural processes, such as post-translational processing, or by chemical modification techniques which are well known in the art. Modifications can occur anywhere in the polypeptide, including the peptide backbone, the amino acid side-chains and the amino or carboxyl termini. It will be appreciated that the same type of modification can be present in the same or varying degrees at several sites in a given polypeptide. Also a given polypeptide can have many types of modifications. Modifications include, without limitation, acetylation, acylation, ADP-ribosylation, amidation, covalent cross-linking or cyclization, covalent attachment of flavin, covalent attachment of a heme moiety, covalent attachment of a nucleotide or nucleotide derivative, covalent attachment of a lipid or lipid derivative, covalent attachment of a phosphytidylinositol, disulfide bond formation, demethylation, formation of cysteine or pyroglutamate, formylation, gamma-carboxylation, glycosylation, GPI anchor formation, hydroxylation, iodination, methylation, myristolyation, oxidation, pergylation, proteolytic processing, phosphorylation, prenylation, racemization, selenoylation, sulfation, and transfer-RNA mediated addition of amino acids to protein such as arginylation. (See Proteins—Structure and Molecular Properties 2nd Ed., T. E. Creighton, W.H. Freeman and Company, New York (1993); Posttranslational Covalent Modification of Proteins, B. C. Johnson, Ed., Academic Press, New York, pp. 1-12 (1983)).

As used herein, the term "amino acid sequence" refers to a list of abbreviations, letters, characters or words representing amino acid residues.

As used herein, the term "isolated" means that a material has been removed from its original environment. For example, a naturally-occurring polynucleotide or polypeptide present in a living animal is not isolated, but the same polynucleotide or polypeptide, separated from some or all of the coexisting materials in the natural system, is isolated. Such polynucleotides can be part of a vector and/or such polynucleotides or polypeptides could be part of a composition, and would be isolated in that such a vector or composition is not part of its original environment.

As used herein with respect to nucleic acids, the term "recombinant" means that the nucleic acid is covalently joined and adjacent to a nucleic acid to which it is not adjacent in its natural environment. Additionally, as used herein with respect to a particular nucleic acid in a population of nucleic acids, the term "enriched" means that the nucleic acid represents 5% or more of the number of nucleic acids in the population of molecules. Typically, the enriched nucleic acids represent 15% or more of the number of nucleic acids in the population of molecules. More typically, the enriched nucleic acids represent 50%, 90% or more of the number of nucleic acids in the population molecules.

"Recombinant" polypeptides or proteins refer to polypeptides or proteins produced by recombinant DNA techniques, i.e., produced from cells transformed by an exogenous recombinant DNA construct encoding the desired polypeptide or protein. "Synthetic" polypeptides or proteins are those prepared by chemical synthesis (e.g., solid-phase peptide synthesis). Chemical peptide synthesis is well known in the art (see, e.g., Merrifield (1963), *Am. Chem. Soc.* 85:2149-2154; Geysen et al. (1984), *Proc. Natl. Acad. Sci., USA* 81:3998) and synthesis kits and automated-peptide synthesizer are commercially available (e.g., Cambridge Research Biochemicals, Cleveland, United Kingdom; Model 431A synthesizer from Applied Biosystems, Inc., Foster City, Calif.). Such equipment provides ready access to the peptides of the invention, either by direct synthesis or by synthesis of a series of fragments that can be coupled using other known techniques.

As used herein with respect to pairs of nucleic acid or amino acid sequences, "identity" refers to the extent to which the two sequences are invariant at positions within the sequence which can be aligned. The percent identity between two given sequences can be calculated using an algorithm such as BLAST (Altschul et al. (1990), *J. Mol. Biol.* 215:403-410). When using the BLAST algorithm for sequences no longer than 250 nucleotides or about 80 amino acids ("short queries"), the search parameters can be as follows: the filter is off, the scoring matrix is PAM30, the word size is 3 or 2, the E value is 1000 or more, and the gap costs are 11, 1. For sequences longer than 250 nucleotides or 80 amino acid residues, the default search parameters can be used. The BLAST website provides advice for special circumstances which is to be followed in such circumstances.

As used herein, "homology" has the same meaning as "identity" in the context of nucleotide sequences. However, with respect to amino acid sequences, "homology" includes the percentage of identical and conservative amino acid substitutions. Percentages of homology can be calculated according to the algorithms of Smith and Waterman (1981), *Adv. Appl. Math.* 2:482.

As used herein in the context of two or more nucleic acid sequences, two sequences are "substantially identical" when they have at least 99.5% nucleotide identity, when compared and aligned for maximum correspondence, as measured using the known sequence comparison algorithms described above. In addition, for purposes of determining whether sequences are substantially identical, synonymous codons in a coding region may be treated as identical to account for the degeneracy of the genetic code. Typically, the region for determination of substantial identity must span at least about 20 residues, and most commonly the sequences are substantially identical over at least about 25-200 residues.

As used herein in the context of two or more amino acid sequences, two sequences are "substantially identical" when they have at least 99.5% identity, when compared and aligned for maximum correspondence, as measured using the known sequence comparison algorithms described above. In addition, for purposes of determining whether sequences are substantially identical, conservative amino acid substitutions may be treated as identical if the polypeptide substantially retains its biological function.

"Hybridization" refers to the process by which a nucleic acid strand joins with a complementary strand through hydrogen bonding at complementary bases. Hybridization assays can be sensitive and selective so that a particular sequence of interest can be identified even in samples in which it is present at low concentrations. Stringent conditions are defined by concentrations of salt or formamide in the prehybridization and hybridization solutions, or by the hybridization temperature, and are well known in the art. Stringency can be increased by reducing the concentration of salt, increasing the concentration of formamide, or raising the hybridization temperature. In particular, as used herein, "stringent hybridization conditions" include 42° C. in 50% formamide, 5×SSPE, 0.3% SDS, and 200 ng/ml sheared and denatured salmon sperm DNA, and equivalents thereof. Variations on the above ranges and conditions are well known in the art.

The term "variant" refers to polynucleotides or polypeptides of the invention modified at one or more nucleotides or amino acid residues (respectively) and wherein the encoded polypeptide or polypeptide retains nitrilase activity. Variants can be produced by any number of means including, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site-saturated mutagenesis or any combination thereof.

Methods of making peptidomimetics based upon a known sequence is described, for example, in U.S. Pat. Nos. 5,631,280; 5,612,895; and 5,579,250. Use of peptidomimetics can involve the incorporation of a non-amino acid residue with non-amide linkages at a given position. One aspect of the present invention is a peptidomimetic wherein the compound has a bond, a peptide backbone or an amino acid component replaced with a suitable mimic. Examples of unnatural amino acids which may be suitable amino acid mimics include β-alanine, L-α-amino butyric acid, L-γ-amino butyric acid, L-α-amino isobutyric acid, L-ε-amino caproic acid, 7-amino heptanoic acid, L-aspartic acid, L-glutamic acid, N-ε-Boc-N-α-CBZ-L-lysine, N-ε-Boc-N-α-Fmoc-L-lysine, L-methionine sulfone, L-norleucine, L-norvaline, N-α-Boc-N-δCBZ-L-ornithine, N-δ-Boc-N-α-CBZ-L-ornithine, Boc-p-nitro-L-phenylalanine, Boc-hydroxyproline, Boc-L-thioproline.

As used herein, "small molecule" encompasses a molecule having a molecular weight from about 20 daltons to about 1.5 kilodaltons.

The molecular biological techniques, such as subcloning, were performed using routine methods which would be well known to one of skill in the art. (Sambrook, J. Fritsch, E F, Maniatis, T. (1989) Molecular Cloning: A Laboratory Manual (2nd ed.), Cold Spring Harbor Laboratory Press, Plainview N.Y.).

Computer Systems

In one aspect of the invention, any nucleic acid sequence and/or polypeptide sequence of the invention can be stored, recorded, and manipulated on any medium which can be read and accessed by a computer. As used herein, the words "recorded" and "stored" refer to a process for storing information on a computer medium. Another aspect of the invention is a computer readable medium having recorded thereon at least 2, 5, 10, 15 or 20 nucleic acid sequences as set forth in SEQ ID NOS: 1-386, and sequences substantially identical thereto. In a further aspect, another aspect is the comparison among and between nucleic acid sequences or polypeptide sequences of the invention and the comparison between sequences of the invention and other sequences by a computer. Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), particularly computer systems which store and manipulate the sequence information described herein. As used herein, "a computer system" refers to the hardware components, software components, and data storage components used to analyze a sequence (either nucleic acid or polypeptide) as set forth in at least any one of SEQ ID NOS: 1-386 and sequences substantially identical thereto. The computer system typically includes a processor for processing, accessing and manipulating the sequence data. The processor can be any well-known type of central processing unit, such as, for example, the Pentium III from Intel Corporation, or similar processor from Sun, Motorola, Compaq, AMD or International Business Machines.

Typically the computer system is a general purpose system that comprises the processor and one or more internal data storage components for storing data, and one or more data retrieving devices for retrieving the data stored on the data storage components.

In one particular aspect, the computer system includes a processor connected to a bus which is connected to a main memory (preferably implemented as RAM) and one or more internal data storage devices, such as a hard drive and/or other computer readable media having data recorded thereon. In some aspects, the computer system further includes one or more data retrieving device for reading the data stored on the internal data storage devices.

The data retrieving device may represent, for example, a floppy disk drive, a compact disk drive, a magnetic tape drive, or a modem capable of connection to a remote data storage system (e.g., via the internet) etc. In some aspects, the internal data storage device is a removable computer readable medium such as a floppy disk, a compact disk, a magnetic tape, etc. containing control logic and/or data recorded thereon. The computer system may advantageously include or be programmed by appropriate software for reading the control logic and/or the data from the data storage component once inserted in the data retrieving device.

The computer system includes a display which is used to display output to a computer user. It should also be noted that the computer system can be linked to other computer systems in a network or wide area network to provide centralized access to the computer system. In some aspects, the computer system may further comprise a sequence comparison algorithm. A "sequence comparison algorithm" refers to one or more programs which are implemented (locally or remotely) on the computer system to compare a nucleotide sequence with other nucleotide sequences and/or compounds stored within a data storage means.

Uses of Nitrilases

Nitrilases have been identified as key enzymes for the production of chiral α-hydroxy acids, which are valuable intermediates in the fine chemicals industry, and as pharmaceutical intermediates. The nitrilase enzymes of the invention are useful to catalyze the stereoselective hydrolysis of cyanohydrins and aminonitriles, producing chiral α-hydroxy- and α-amino acids, respectively.

Stereoselective enzymes provide a key advantage over chemical resolution methods as they do not require harsh conditions and are more environmentally compatible. The use of nitrilases is of particular interest for the production of chiral amino acids and α-hydroxy acids. Using a stereoselective nitrilase, dynamic resolution conditions can be established, due to the racemisation of the substrate under aqueous conditions. Thus 100% theoretical yields are achievable.

This invention is directed to the nitrilases which have been discovered and isolated from naturally occurring sources. This invention is also directed to evolving novel genes and gene pathways from diverse and extreme environmental sources. In an effort to develop the most extensive assortment of enzymes available, DNA was extracted directly from samples that have been collected from varying habitats around the globe. From these efforts, the largest collection of environmental genetic libraries in the world was developed. Through extensive high-throughput screening of these libraries, 192 new sequence-unique nitrilase enzymes have been discovered to date. Previous to this invention, fewer than 20 microbial-derived nitrilases had been reported in the literature and public databases.

Biocatalysts, such as nitrilases, play an important role in catalyzing metabolic reactions in living organisms. In addition, biocatalysts have found applications in the chemical industry, where they can perform many different reactions. Some examples of the advantages of the use of nitrilases is that they provide: high enantio-, chemo- and regio-selectivity; they function under mild reaction conditions; they provide direct access to products—with minimal protection; they have high catalytic efficiencies; they produce reduced waste compared with the chemical alternatives; they are easily immobilized as enzymes or cells; they are recoverable, recyclable and are capable of being manipulated via molecular biological techniques; they can be regenerated in whole cell processes; they are tolerant to organic solvents; and importantly, they can be evolved or optimized. Optimized nitrilases are presented herein as working examples of the invention.

Nitrilases catalyze the hydrolysis of nitrile moieties generating the corresponding carboxylic acid. Conventional chemical hydrolysis of nitrites requires strong acid or base and high temperature. However, one advantage of the invention is that nitrilases are provided which perform this reaction under mild conditions. Wide ranges of nitrile substrates can be transformed by nitrilases with high enantio-, chemo- and regio-selectivity.

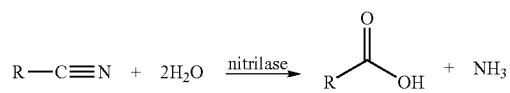

TABLE 1

Some characteristics of Nitrilases of the Invention

| Previously Discovered Nitrilases | New Nitrilases | |
|---|---|---|
| Limitations | New Features | Benefits |
| <20 reported Homologous | >180 newly discovered Unique nitrilases, many with little homology to | Access to a wider substrate range |

TABLE 1-continued

Some characteristics of Nitrilases of the Invention

| Previously Discovered Nitrilases | New Nitrilases | |
|---|---|---|
| Limitations | New Features | Benefits |
| Narrow substrate Activity spectrum | previously known nitrilases Broad substrate activity spectrum | |
| Very few shown to be enantioselective | Enantioselective; both enantiomers accessible | Product with high enantiomeric excess and minimal waste production |
| Limited stability profile | Stable in a variety of conditions | Potential use in a wide range of process conditions |
| Inconsistent supply | Consistent supply | Reliable source of product |
| Not applicable | Amenable to optimization | Good source material leads to better product |

Dynamic Kinetic Resolution: The use of the nitrilases allows discrimination between two rapidly equilibrating enantiomers to give a single product in 100% theoretical yield. Nitrilases are utilized for dynamic resolution of key cyanohydrins and aminonitriles to produce enantiomerically pure α-carboxylic and α-amino acids. Newly discovered nitrilases disclosed herein yield products with >95% enantiomeric excess (ee) with and >95% yield. The nitrilases perform this transformation efficiently under mild conditions in aqueous solution or in the presence of organic solvent.

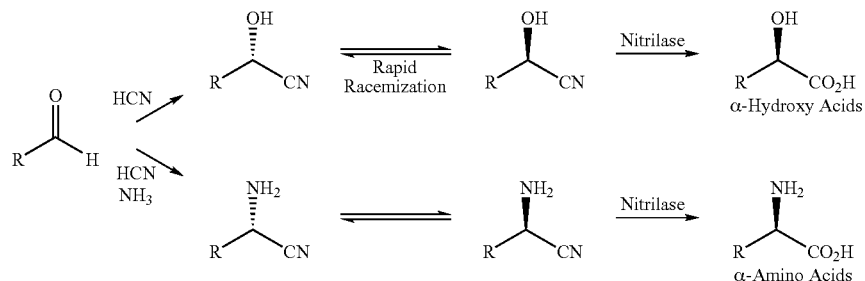

These products shown above also include the opposite enanatiomers, although they are not shown. In one aspect, the invention provides an isolated nucleic acid having a sequence as set forth in any one of the Group A nucleic acid sequences, having a sequence substantially identical thereto, or having a sequence complementary thereto.

In another aspect, the invention provides an isolated nucleic acid including at least 20 consecutive nucleotides identical to a portion of a nucleotide sequence as set forth in the Group A nucleic acid sequences, having a sequence substantially identical thereto, or having a sequence complementary thereto.

In another aspect, the invention provides an isolated nucleic acid encoding a polypeptide having a sequence as set forth in the Group B amino acid sequences, or having a sequence substantially identical thereto.

In another aspect, the invention provides an isolated nucleic acid encoding a polypeptide having at least 10 consecutive amino acids identical to a portion of a sequence as set forth in the Group B amino acid sequences, or having a sequence substantially identical thereto.

In yet another aspect, the invention provides a substantially purified polypeptide comprising consecutive amino acid residues having a sequence as set forth in the Group B amino acid sequences, or having a sequence substantially identical thereto.

In another aspect, the invention provides an isolated antibody that specifically binds to a polypeptide of the invention. The invention also provides for a fragment of the antibody which retains the ability to specifically bind the polypeptide.

In another aspect, the invention provides a method of producing a polypeptide having a sequence as set forth in the Group B amino acid sequences, and sequences substantially identical thereto. The method includes introducing a nucleic acid encoding the polypeptide into a host cell, wherein the nucleic acid is operably joined to a promoter, and culturing the host cell under conditions that allow expression of the nucleic acid.

In another aspect, the invention provides a method of producing a polypeptide having at least 10 consecutive amino acids from a sequence as set forth in the Group B amino acid sequences, and sequences substantially identical thereto. The method includes introducing a nucleic acid encoding the polypeptide into a host cell, wherein the nucleic acid is operably joined to a promoter, and culturing the host cell under conditions that allow expression of the nucleic acid, thereby producing the polypeptide.

In another aspect, the invention provides a method of generating a variant of a nitrilase, including choosing a nucleic acid sequence as set forth in the Group A nucleic acid sequences, and changing one or more nucleotides in the sequence to another nucleotide, deleting one or more nucleotides in the sequence, or adding one or more nucleotides to the sequence.

In another aspect, the invention provides assays for identifying functional variants of the Group B amino acid sequences that retain the enzymatic function of the polypeptides of the Group B amino acid sequences. The assays include contacting a polypeptide comprising consecutive amino acid residues having a sequence identical to a sequence of the Group B amino acid sequences or a portion thereof, having a sequence substantially identical to a sequence of the Group B amino acid sequences or a portion thereof, or having a sequence which is a variant of a sequence of the Group B amino acid sequences that retains nitrilase activity, with a substrate molecule under conditions which allow the polypeptide to function, and detecting either a decrease in the level of substrate or an increase in the level of a specific reaction product of the reaction between the polypeptide and the substrate, thereby identifying a functional variant of such sequences.

Modification of Polypeptides of the Invention

Enzymes are highly selective catalysts. Their hallmark is the ability to catalyze reactions with exquisite stereo-selectivity, regio-selectivity, and chemo-selectivity that is unparalleled in conventional synthetic chemistry. Moreover, enzymes are remarkably versatile. They can be tailored to function in organic solvents, operate at extreme pHs (for example, acidic or basic conditions) extreme temperatures (for example, high temperatures and low temperatures), extreme salinity levels (for example, high salinity and low salinity), and catalyze reactions with compounds that can be structurally unrelated to their natural, physiological substrates except for the enzymatic active site.

The invention provides methods for modifying polypeptides having nitrilase activity or polynucleotides encoding such polypeptides in order to obtain new polypeptides which retain nitrilase activity but which are improved with respect to some desired characteristic. Such improvements can include the ability to function (i.e., exhibit nitrilase activity) in organic solvents, operate at extreme or uncharacteristic pHs, operate at extreme or uncharacteristic temperatures, operate at extreme or uncharacteristic salinity levels, catalyze reactions with different substrates, etc.

The present invention directed to methods of using nitrilases so as to exploit the unique catalytic properties of these enzymes. Whereas the use of biocatalysts (i.e., purified or crude enzymes) in chemical transformations normally requires the identification of a particular biocatalyst that reacts with a specific starting compound, the present invention uses selected biocatalysts and reaction conditions that are specific for functional groups that are present in many starting compounds. Each biocatalyst is specific for one functional group, or several related functional groups, and can react with many starting compounds containing this functional group.

Enzymes react at specific sites within a starting compound without affecting the rest of the molecule, a process which is very difficult to achieve using traditional chemical methods. This high degree of specificity provides the means to identify a single active compound within a library of compounds. The library is characterized by the series of biocatalytic reactions used to produce it, a so-called "biosynthetic history." Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies, and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library. (For further teachings on modification of molecules, including small molecules, see PCT Application No. PCT/US94/09174, herein incorporated by reference in its entirety).

In one exemplification, the invention provides for the chimerization of a family of related nitrilase genes and their encoded family of related products. Thus according to this aspect of the invention, the sequences of a plurality of nitrilase nucleic acids (e.g., the Group A nucleic acids) serve as nitrilase "templates" which are aligned using a sequence comparison algorithm such as those described above. One or more demarcation points are then identified in the aligned template sequences, which are located at one or more areas of homology. The demarcation points can be used to delineate the boundaries of nucleic acid building blocks, which are used to generate chimeric nitrilases. Thus, the demarcation points identified and selected in the nitrilase template molecules serve as potential chimerization points in the assembly of the chimeric nitrilase molecules.

Typically, a useful demarcation point is an area of local identity between at least two progenitor templates, but preferably the demarcation point is an area of identity that is shared by at least half of the templates, at least two thirds of the templates, at least three fourths of the templates, or at nearly all of the templates.

The building blocks, which are defined by the demarcation points, can then be mixed (either literally, in solution, or theoretically, on paper or in a computer) and reassembled to form chimeric nitrilase genes. In one aspect, the gene reassembly process is performed exhaustively in order to generate an exhaustive library of all possible combinations. In other words, all possible ordered combinations of the nucleic acid building blocks are represented in the set of finalized chimeric nucleic acid molecules. At the same time, however, the order of assembly of each building block in the 5' to 3' direction in each combination is designed to reflect the order in the templates, and to reduce the production of unwanted, inoperative products.

In some aspects, the gene reassembly process is performed systematically, in order to generate a compartmentalized library with compartments that can be screened systematically, e.g., one by one. In other words, the invention provides that, through the selective and judicious use of specific nucleic acid building blocks, coupled with the selective and judicious use of sequentially stepped assembly reactions, an experimental design can be achieved where specific sets of chimeric products are made in each of several reaction vessels. This allows a systematic examination and screening procedure to be performed. Thus, it allows a potentially very large number of chimeric molecules to be examined systematically in smaller groups.

In some aspects, the synthetic nature of the step in which the building blocks are generated or reassembled allows the design and introduction of sequences of nucleotides (e.g., codons or introns or regulatory sequences) that can later be optionally removed in an in vitro process (e.g., by mutagenesis) or in an in vivo process (e.g., by utilizing the gene splicing ability of a host organism). The introduction of these nucleotides may be desirable for many reasons, including the potential benefit of creating a useful demarcation point.

The synthetic gene reassembly method of the invention utilizes a plurality of nucleic acid building blocks, each of which has two ligatable ends. Some examples of the two ligatable ends on each nucleic acid building block includes, but are not limited to, two blunt ends, or one blunt end and one overhang, or two overhangs. In a further, non-limiting example, the overhang can include one base pair, 2 base pairs, 3 base pairs, 4 base pairs or more.

A double-stranded nucleic acid building block can be of variable size. Preferred sizes for building blocks range from about 1 base pair (bp) (not including any overhangs) to about 100,000 base pairs (not including any overhangs). Other preferred size ranges are also provided, which have lower limits of from about 1 bp to about 10,000 bp (including every integer value in between), and upper limits of from about 2 bp to about 100,000 bp (including every integer value in between).

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). Alternatively, the two strands of a double-stranded nucleic acid building block can be complementary at fewer than every nucleotide, apart from any overhang(s). In particular, mismatches between the strands can be used to introduce codon degeneracy using methods such as the site-saturation mutagenesis described herein.

In vivo shuffling of molecules is also useful in providing variants and can be performed utilizing the natural property of cells to recombine multimers. While recombination in vivo has provided the major natural route to molecular diversity, genetic recombination remains a relatively complex process that involves (1) the recognition of homologies; (2) strand cleavage, strand invasion, and metabolic steps leading to the production of recombinant chiasma; and finally (3) the resolution of chiasma into discrete recombined molecules. The formation of the chiasma requires the recognition of homologous sequences.

Thus, the invention includes a method for producing a chimeric or recombinant polynucleotide from at least a first polynucleotide and a second polynucleotide in vivo. The invention can be used to produce a recombinant polynucleotide by introducing at least a first polynucleotide and a second polynucleotide which share at least one region of partial sequence homology (e.g., the Group A nucleic acid sequences, and combinations thereof) into a suitable host cell. The regions of partial sequence homology promote processes which result in sequence reorganization producing a recombinant polynucleotide. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

The invention provides a means for generating recombinant polynucleotides which encode biologically active variant polypeptides (e.g., a nitrilase variant). For example, a polynucleotide may encode a particular enzyme from one microorganism. An enzyme encoded by a first polynucleotide from one organism can, for example, function effectively under a particular environmental condition, e.g., high salinity. An enzyme encoded by a second polynucleotide from a different organism can function effectively under a different environmental condition, such as extremely high temperature. A recombined polynucleotide containing sequences from the first and second original polynucleotides encodes a variant enzyme which exhibits characteristics of both enzymes encoded by the original polynucleotides. Thus, the enzyme encoded by the recombined polynucleotide can function effectively under environmental conditions shared by each of the enzymes encoded by the first and second polynucleotides, e.g., high salinity and extreme temperatures.

A variant polypeptide can exhibit specialized enzyme activity not displayed in the original enzymes. For example, following recombination and/or reductive reassortment of polynucleotides encoding nitrilase activity, the resulting variant polypeptide encoded by a recombined polynucleotide can be screened for specialized nitrilase activity obtained from each of the original enzymes, i.e., the temperature or pH at which the nitrilase functions. Sources of the original polynucleotides may be isolated from individual organisms ("isolates"), collections of organisms that have been grown in defined media ("enrichment cultures"), or, uncultivated organisms ("environmental samples"). The use of a culture-independent approach to derive polynucleotides encoding novel bioactivities from environmental samples is most preferable since it allows one to access untapped resources of biodiversity. The microorganisms from which the polynucleotide may be prepared include prokaryotic microorganisms, such as *Xanthobacter, Eubacteria* and *Archaebacteria*, and lower eukaryotic microorganisms such as fungi, some algae and protozoa. Polynucleotides may be isolated from environmental samples in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms are particularly preferred. Such enzymes may function at temperatures above 100° C. in terrestrial hot springs and deep sea thermal vents, at temperatures below 0° C. in arctic waters, in the saturated salt environment of the Dead Sea, at pH values around 0 in coal deposits and geothermal sulfur-rich springs, or at pH values greater than 11 in sewage sludge.

Examples of mammalian expression systems that can be employed to express recombinant proteins include the COS-7, C127, 3T3, CHO, HeLa and BHK cell lines. Mammalian expression vectors comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice and polyadenylation sites may be used to provide the required nontranscribed genetic elements. U.S. Pat. No. 6,054,267 is hereby incorporated by reference in its entirety.

Host cells containing the polynucleotides of interest can be cultured in conventional nutrient media modified as appropriate for activating promoters, selecting transformants or amplifying genes. The culture conditions, such as temperature, pH and the like, are those previously used with the host cell selected for expression, and will be apparent to the ordinarily skilled artisan. Clones, which are identified as having a desired enzyme activity or other property may then be sequenced to identify the recombinant polynucleotide sequence encoding the enzyme having the desired activity or property.

In one aspect, the invention provides for the isolated nitrilases as either an isolated nucleic acid or an isolated polypeptide wherein the nucleic acid or the polypeptide was prepared by recovering DNA from a DNA population derived from at least one uncultivated microorganism, and transforming a host with recovered DNA to produce a library of clones which is screened for the specified protein, e.g. nitrilase activity. U.S. Pat. No. 6,280,926, Short, provides descriptions of such methods and is hereby incorporated by reference in its entirety for all purposes.

Therefore, in a one aspect, the invention relates to a method for producing a biologically active recombinant nitrilase polypeptide and screening such a polypeptide for desired activity or property by:

1) introducing at least a first nitrilase polynucleotide and a second nitrilase polynucleotide, said at least first nitrilase polynucleotide and second nitrilase polynucleotide sharing at least one region of sequence homology, into a suitable host cell;

2) growing the host cell under conditions which promote sequence reorganization resulting in a recombinant nitrilase polynucleotide;

3) expressing a recombinant nitrilase polypeptide encoded by the recombinant nitrilase polynucleotide;

4) screening the recombinant nitrilase polypeptide for the desired activity or property; and 5) isolating the recombinant nitrilase polynucleotide encoding the recombinant nitrilase polypeptide.

Examples of vectors which may be used include viral particles, baculovirus, phage, plasmids, phagemids, cosmids, fosmids, bacterial artificial chromosomes, viral DNA (e.g., vaccinia, adenovirus, fowlpox virus, pseudorabies and derivatives of SV40), P1-based artificial chromosomes, yeast plasmids, yeast artificial chromosomes, and any other vectors specific for the hosts of interest (e.g., *Bacillus, Aspergillus* and yeast). Large numbers of suitable vectors are known to those of skill in the art, and are commercially available. Examples of bacterial vectors include pQE vectors (Qiagen, Valencia, Calif.); pBluescript plasmids, pNH vectors, and lambda-ZAP vectors (Stratagene, La Jolla, Calif.); and pTRC99a, pKK223-3, pDR540, and pRIT2T vectors (Pharmacia, Peapack, N.J.). Examples of eukaryotic vectors include pXT1 and pSG5 vectors (Stratagene, La Jolla, Calif.); and pSVK3, pBPV, pMSG, and pSVLSV40 vectors (Pharmacia, Peapack, N.J.). However, any other plasmid or other vector may be used so long as they are replicable and viable in the host.

A preferred type of vector for use in the present invention contains an f-factor (or fertility factor) origin of replication. The f-factor in *E. coli* is a plasmid which effects high frequency transfer of itself during conjugation and less frequent transfer of the bacterial chromosome itself. A particularly preferred aspect is to use cloning vectors referred to as "fosmids" or bacterial artificial chromosome (BAC) vectors. These are derived from *E. coli* f-factor which is able to stably integrate large segments of genomic DNA.

The DNA sequence in the expression vector is operably joined to appropriate expression control sequences, including a promoter, to direct RNA synthesis. Useful bacterial promoters include lacI, lacZ, T3, T7, gpt, lambda $P_R$, $P_L$ and trp. Useful eukaryotic promoters include CMV immediate early, HSV thymidine kinase, early and late SV40, LTRs from retrovirus, and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using CAT (chloramphenicol transferase) vectors or other vectors with selectable markers.

In addition, the expression vectors can contain one or more selectable marker genes to provide a phenotypic trait for selection of transformed host cells. Useful selectable markers include dihydrofolate reductase or neomycin resistance for eukaryotic cell culture, or tetracycline or ampicillin resistance in *E. coli*.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation Reductive Reassortment—In another aspect, variant nitrilase polynucleotides can be generated by the process of reductive reassortment. Whereas recombination is an "intermolecular" process which, in bacteria, is generally viewed as a "recA-dependent" phenomenon, the process of "reductive reassortment" occurs by an "intra-molecular", recA-independent process. In this aspect, the invention can rely on the ability of cells to mediate reductive processes to decrease the complexity of quasi-repeated sequences in the cell by deletion. The method involves the generation of constructs containing consecutive repeated or quasi-repeated sequences (original encoding sequences), the insertion of these sequences into an appropriate vector, and the subsequent introduction of the vector into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences, and results in the production of novel molecular species. Various treatments may be applied to enhance the rate of reassortment, such as ultra-violet light or DNA damaging chemicals. In addition, host cell lines displaying enhanced levels of "genetic instability" can be used.

Repeated Sequences—Repeated or "quasi-repeated" sequences play a role in genetic instability. In the present invention, "quasi-repeats" are repeats that are not identical in structure but, rather, represent an array of consecutive sequences which have a high degree of similarity or identity sequences. The reductive reassortment or deletion process in the cell reduces the complexity of the resulting construct by deleting sequences between positions within quasi-repeated sequences. Because the deletion (and potentially insertion) events can occur virtually anywhere within the quasi-repetitive units, these sequences provide a large repertoire of potential variants.

When the quasi-repeated sequences are all ligated in the same orientation, for instance head-to-tail or vice versa, the endpoints of a deletion are, for the most part, equally likely to occur anywhere within the quasi-repeated sequences. In contrast, when the units are presented head-to-head or tail-to-tail, the inverted quasi-repeated sequences can form a duplex which delineates the endpoints of the adjacent units and thereby favors deletion of discrete units. Therefore, it is preferable in the present invention that the quasi-repeated sequences are joined in the same orientation because random orientation of quasi-repeated sequences will result in the loss of reassortment efficiency, while consistent orientation of the sequences will offer the highest efficiency. Nonetheless, although having fewer of the contiguous sequences in the same orientation decreases the efficiency or reductive reassortment, it may still provide sufficient variation for the effective recovery of novel molecules.

Sequences can be assembled in a head-to-tail orientation using any of a variety of methods, including the following:

a) Primers can be utilized that include a poly-A head and poly-T tail which, when made single-stranded, would provide orientation. This is accomplished by having the first few bases of the primers made from RNA and hence easily removed by RNAse H.

b) Primers can be utilized that include unique restriction cleavage sites. Multiple sites, a battery of unique sequences, and repeated synthesis and ligation steps would be required.

c) The inner few bases of the primer can be thiolated and an exonuclease used to produce properly tailed molecules.

The recovery of the reassorted sequences relies on the identification of cloning vectors with a reduced repetitive index (RI). The reasserted coding sequences can then be recovered by amplification. The products are recloned and expressed. The recovery of cloning vectors with reduced RI can be effected by:

1) The use of vectors only stably maintained when the construct is reduced in complexity.

2) The physical recovery of shortened vectors by physical procedures. In this case, the cloning vector would be recovered using standard plasmid isolation procedures and then size-fractionated using standard procedures (e.g., agarose gel or column with a low molecular weight cut off).

3) The recovery of vectors containing interrupted genes can be selected when insert size decreases.

4) The use of direct selection techniques wherein an expression vector is used and the appropriate selection is carried out.

Coding sequences from related organisms may demonstrate a high degree of homology but nonetheless encode quite diverse protein products. These types of sequences are particularly useful in the present invention as quasi-repeats. However, while the examples illustrated below demonstrate the reassortment of coding sequences with a high 5 degree of identity (quasi-repeats), this process is not limited to nearly identical repeats.

The following example demonstrates a method of the invention. Quasi-repetitive coding sequences derived from three different species are obtained. Each sequence encodes a protein with a distinct set of properties. Each of the sequences differs by one or more base pairs at unique positions in the sequences which are designated "A", "B" and "C". The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs can be size-fractionated on an agarose gel according to published protocols, inserted into a cloning vector, and transfected into an appropriate host cell. The cells can then be propagated to allow reductive reassortment to occur. The rate of the reductive reassortment process may be stimulated by the introduction of DNA damage if desired. Whether the reduction in RI is mediated by deletion formation between repeated sequences by an "intra-molecular" mechanism, or mediated by recombination-like events through "inter-molecular" mechanisms is immaterial. The end result is a reassortment of the molecules into all possible combinations.

In another aspect, prior to or during recombination or reassortment, polynucleotides of the invention or polynucleotides generated by the methods described herein can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis include, but are not limited to: (+)-CC-1065, or a synthetic analog such as (+)-CC-1065-(N3-adenine) (Sun et al. (1992), *Biochemistry* 31(10):2822-9); an N-acetylated or deacetylated 4'-fluoro-4-aminobiphenyl adduct capable of inhibiting DNA synthesis (see, for example, van de Poll et al. (1992), *Carcinogenesis* 13(5):751-8); or a N-acetylated or deacetylated 4-aminobiphenyl adduct capable of inhibiting DNA synthesis (see also, Van de Poll et al. (1992), supra); trivalent chromium, a trivalent chromium salt, a polycyclic aromatic hydrocarbon ("PAH") DNA adduct capable of inhibiting DNA replication, such as 7-bromomethyl-benz[a]anthracene ("BMA"), tris(2,3-dibromopropyl)phosphate ("Tris-BP"), 1,2-dibromo-3-chloropropane ("DBCP"), 2-bromoacrolein (2BA), benzo[a]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ"), and N-hydroxy-2-amino-1-methyl-6-phenylimidazo[4,5-f]-pyridine ("N-hydroxy-PhIP"). Especially preferred means for slowing or halting PCR amplification consist of UV light (+)-CC-1065 and (+)-CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

GSSM™—The invention also provides for the use of codon primers containing a degenerate N,N,G/T sequence to introduce point mutations into a polynucleotide, so as to generate a set of progeny polypeptides in which a full range of single amino acid substitutions is represented at each amino acid position, a method referred to as gene site-saturated mutagenesis (GSSM™). The oligos used are comprised contiguously of a first homologous sequence, a degenerate N,N, G/T sequence, and possibly a second homologous sequence. The progeny translational products from the use of such oligos include all possible amino acid changes at each amino acid site along the polypeptide, because the degeneracy of the N,N,G/T sequence includes codons for all 20 amino acids.

In one aspect, one such degenerate oligo (comprising one degenerate N,N,G/T cassette) is used for subjecting each original codon in a parental polynucleotide template to a full range of codon substitutions. In another aspect, at least two degenerate N,N,G/T cassettes are used—either in the same oligo or not, for subjecting at least two original codons in a parental polynucleotide template to a full range of codon substitutions. Thus, more than one N,N,G/T sequence can be contained in one oligo to introduce amino acid mutations at more than one site. This plurality of N,N,G/T sequences can be directly contiguous, or separated by one or more additional nucleotide sequences. In another aspect, oligos serviceable for introducing additions and deletions can be used either alone or in combination with the codons containing an N,N, G/T sequence, to introduce any combination or permutation of amino acid additions, deletions, and/or substitutions.

In a particular exemplification, it is possible to simultaneously mutagenize two or more contiguous amino acid positions using an oligo that contains contiguous N,N,G/T triplets, i.e., a degenerate (N,N,G/T), sequence.

In another aspect, the present invention provides for the use of degenerate cassettes having less degeneracy than the N,N, G/T sequence. For example, it may be desirable in some instances to use a degenerate triplet sequence comprised of only one N, where said N can be in the first second or third position of the triplet. Any other bases including any combinations and permutations thereof can be used in the remaining two positions of the triplet. Alternatively, it may be desirable in some instances to use a degenerate N,N,N triplet sequence, or an N,N, G/C triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of the 20 possible amino acids into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for the 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligonucleotides, which can optionally be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes, and point mutations that cause the generation of stop codons and the corresponding expression of polypeptide fragments.

Thus, in one aspect, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable *E. coli* host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e., 2 at each of three positions) and no change at any position.

In yet another aspect, site-saturation mutagenesis can be used together with shuffling, chimerization, recombination and other mutagenizing processes, along with screening. This invention provides for the use of any mutagenizing process (es), including saturation mutagenesis, in an iterative manner. In one exemplification, the iterative use of any mutagenizing process(es) is used in combination with screening.

Thus, in a non-limiting exemplification, polynucleotides and polypeptides of the invention can be derived by saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, mutagenesis can be used to replace each of any number of bases in a polynucleotide sequence, wherein the number of bases to be mutagenized can be each integer from about 15 to about 100,000. Thus, instead of mutagenizing every position along a molecule, one can subject every or a discrete number of bases (e.g., a subset totaling from about 15 to about 100,000) to mutagenesis. In one aspect, a separate nucleotide is used for mutagenizing each position or group of positions along a polynucleotide sequence. A group of 3 positions to be mutagenized can be a codon. In one aspect, the mutations are introduced using a mutagenic primer, containing a heterologous cassette, also referred to as a mutagenic cassette. For example, cassettes can have from about 1 to about 500 bases. Each nucleotide position in such heterologous cassettes can be N, A, C, G, T, A/C, A/G, A/T, C/G, C/T, G/T, C/G/T, A/G/T, A/C/T, A/C/G, or E, where E is any base that is not A, C, G, or T.

In a general sense, saturation mutagenesis comprises mutagenizing a complete set of mutagenic cassettes (for example, each cassette is about 1-500 bases in length) in a defined polynucleotide sequence to be mutagenized (for example, the sequence to be mutagenized is from about 15 to about 100,000 bases in length). Thus, a group of mutations (ranging from about 1 to about 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons, and groupings of particular nucleotide cassettes.

Defined sequences to be mutagenized include a whole gene, pathway, cDNA, entire open reading frame (ORF), promoter, enhancer, repressor/transactivator, origin of replication, intron, operator, or any polynucleotide functional group. Generally, a "defined sequence" for this purpose may be any polynucleotide that a 15 base-polynucleotide sequence, and polynucleotide sequences of lengths between about 15 bases and about 15,000 bases (this invention specifically names every integer in between). Considerations in choosing groupings of codons include types of amino acids encoded by a degenerate mutagenic cassette.

In a particularly preferred exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19, and 20 amino acids at each position, and a library of polypeptides encoded thereby.

One aspect of the invention is an isolated nucleic acid comprising one of the sequences of the Group A nucleic acid sequences, sequences substantially identical thereto, sequences complementary thereto, or a fragment comprising at least 10, 15, 20, 25, 30, 35, 40, 50, 75, 100, 150, 200, 300, 400, or 500 consecutive bases of one of the sequences of the Group A nucleic acid sequences. The isolated nucleic acids may comprise DNA, including cDNA, genomic DNA, and synthetic DNA. The DNA may be double-stranded or single-stranded, and if single stranded may be the coding strand or non-coding (anti-sense) strand. Alternatively, the isolated nucleic acids may comprise RNA.

As discussed in more detail below, the isolated nucleic acid sequences of the invention may be used to prepare one of the polypeptides of the Group B amino acid sequences, and sequences substantially identical thereto, or fragments comprising at least 5, 10, 15, 20, 25, 30, 35, 40, 50, 75, 100, or 150 consecutive amino acids of one of the polypeptides of the Group B amino acid sequences, and sequences substantially identical thereto.

Alternatively, the nucleic acid sequences of the invention may be mutagenized using conventional techniques, such as site directed mutagenesis, or other techniques familiar to those skilled in the art, to introduce silent changes into the polynucleotides of the Group A nucleic acid sequences, and sequences substantially identical thereto. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of the invention (e.g., the Group B amino acid sequences). Such nucleotide changes may be introduced using techniques such as site-directed mutagenesis, random chemical mutagenesis, exonuclease III deletion, and other recombinant DNA techniques. Alternatively, such nucleotide changes may be naturally occurring allelic variants which are isolated by identifying nucleic acid sequences which specifically hybridize to probes comprising at least 10, 15, 20, 25, 30, 35, 40, 50, 75, 100, 150, 200, 300, 400, or 500 consecutive bases of one of the sequences of the Group A nucleic acid sequences, and sequences substantially identical thereto (or the sequences complementary thereto) under conditions of high, moderate, or low stringency as provided herein.

Immobilized Enzyme Solid Supports

The enzymes, fragments thereof and nucleic acids which encode the enzymes and fragments can be affixed to a solid support. This is often economical and efficient in the use of the enzymes in industrial processes. For example, a consortium or cocktail of enzymes (or active fragments thereof), which are used in a specific chemical reaction, can be attached to a solid support and dunked into a process vat. The enzymatic reaction can occur. Then, the solid support can be taken out of the vat, along with the enzymes affixed thereto, for repeated use. In one aspect of the invention, the isolated nucleic acid is affixed to a solid support. In another aspect of the invention, the solid support is selected from the group of a gel, a resin, a polymer, a ceramic, a glass, a microelectrode and any combination thereof.

For example, solid supports useful in this invention include gels. Some examples of gels include sepharose, gelatin, glutaraldehyde, chitosan-treated glutaraldehyde, albumin-glutaraldehyde, chitosan-Xanthan, toyopearl gel (polymer gel), alginate, alginate-polylysine, carrageenan, agarose, glyoxyl agarose, magnetic agarose, dextran-agarose, poly(Carbamoyl Sulfonate) hydrogel, BSA-PEG hydrogel, phosphorylated polyvinyl alcohol (PVA), monoaminoethyl-N-aminoethyl (MANA), amino, or any combination thereof.

Another solid support useful in the present invention are resins or polymers. Some examples of resins or polymers include cellulose, acrylamide, nylon, rayon, polyester, anion-exchange resin, AMBERLITE™ XAD-7, AMBERLITE™ XAD-8, AMBERLITE™ IRA-94, AMBERLITE™ IRC-50, polyvinyl, polyacrylic, polymethacrylate, or any combination thereof. Another type of solid support useful in the present invention is ceramic. Some examples include non-porous ceramic, porous ceramic, $SiO_2$, $Al_2O_3$. Another type of solid support useful in the present invention is glass. Some examples include non-porous glass, porus glass, aminopropyl glass or any combination thereof. Another type of solid support which can be used is a microelectrode. An example is a polyethyleneimine-coated magnetite. Graphitic particles can be used as a solid support. Another example of a solid support is a cell, such as a red blood cell.

Methods of Immobilization

There are many methods which would be known to one of skill in the art for immobilizing enzymes or fragments thereof, or nucleic acids, onto a solid support. Some examples of such methods include electrostatic droplet generation, electrochemical means, via adsorption, via covalent binding, via cross-linking, via a chemical reaction or process, via encapsulation, via entrapment, via calcium alginate, or via poly (2-hydroxyethyl methacrylate). Like methods are described in *Methods in Enzymology, Immobilized Enzymes and Cells*, Part C. 1987. Academic Press. Edited by S. P. Colowick and N, O. Kaplan. Volume 136; and Immobilization of Enzymes and Cells. 1997. Humana Press. Edited by G. F. Bickerstaff. Series: Methods in Biotechnology, Edited by J. M. Walker.

Probes—The isolated nucleic acids of the Group A nucleic acid sequences, sequences substantially identical thereto, complementary sequences, or a fragment comprising at least 10, 15, 20, 25, 30, 35, 40, 50, 75, 100, 150, 200, 300, 400, or 500 consecutive bases of one of the foregoing sequences may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, can be varied to identify conditions which allow the probe to hybridize specifically to complementary nucleic acids. Stringent hybridization conditions are recited herein.

Hybridization may be detected by labeling the probe with a detectable agent such §0 as a radioactive isotope, a fluorescent dye or an enzyme capable of catalyzing the formation of a detectable product. Many methods for using the labeled probes to detect the presence of complementary nucleic acids in a sample are familiar to those skilled in the art. These include Southern Blots, Northern Blots, colony hybridization procedures, and dot blots. Protocols for each of these procedures are provided in Ausubel et al. (1997), Current Protocols in Molecular Biology, John Wiley & Sons, Inc., and Sambrook et al. (1989), Molecular Cloning: A Laboratory Manual 2d Ed., Cold Spring Harbor Laboratory Press, the entire disclosures of which are incorporated herein by reference.

In one example, a probe DNA is "labeled" with one partner of a specific binding pair (i.e., a ligand) and the other partner of the pair is bound to a solid matrix to provide ease of separation of target from its source. For example, the ligand and specific binding partner can be selected from, in either orientation, the following: (1) an antigen or hapten and an antibody or specific binding fragment thereof; (2) biotin or iminobiotin and avidin or streptavidin; (3) a sugar and a lectin specific therefor; (4) an enzyme and an inhibitor therefor; (5) an apoenzyme and cofactor; (6) complementary homopolymeric oligonucleotides; and (7) a hormone and a receptor therefor. In one example, the solid phase is selected from: (1) a glass or polymeric surface; (2) a packed column of polymeric beads; and (3) magnetic or paramagnetic particles.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one aspect, the amplification reaction may comprise a PCR reaction. PCR protocols are described in Ausubel et al. (1997), supra, and Sambrook et al. (1989), supra. Alternatively, the amplification may comprise a ligase chain reaction, 3SR, or strand displacement reaction. (See Barany (1991), *PCR Methods and Applications* 1:5-16; Fahy et al. (1991), *PCR Methods and Applications* 1:25-33; and Walker et al. (1992), *Nucleic Acid Research* 20:1691-1696, the disclosures of which are incorporated herein by reference in their entireties).

Probes derived from sequences near the ends of a sequence as set forth in the Group A nucleic acid sequences, and sequences substantially identical thereto, may also be used in chromosome walking procedures to identify clones containing genomic sequences located adjacent to the nucleic acid sequences as set forth above. Such methods allow the isolation of genes which encode additional proteins from the host organism.

An isolated nucleic acid sequence as set forth in the Group A nucleic acid sequences, sequences substantially identical thereto, sequences complementary thereto, or a fragment comprising at least 10, 15, 20, 25, 30, 35, 40, 50, 75, 100, 150, 200, 300, 400, or 500 consecutive bases of one of the foregoing sequences may be used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

In nucleic acid hybridization reactions, the conditions used to achieve a particular level of stringency will vary, depending on the nature of the nucleic acids being hybridized. For example, the length of the nucleic acids, the amount of complementarity between the nucleic acids, the nucleotide sequence composition (e.g., G-C rich v. A-T rich content), and the nucleic acid type (e.g., RNA v. DNA) can be considered in selecting hybridization conditions. Stringency may be varied by conducting the hybridization at varying temperatures below the melting temperatures of the probes. The melting temperature, Tm, is the temperature (under defined ionic strength and pH) at which 50% of the target sequence hybridizes to a perfectly complementary probe. Stringent conditions are selected to be equal to or about 5° C. lower than the Tm for a particular probe. The melting temperature of the probe may be calculated using the following formulas:

For probes between 14 and 70 nucleotides in length the melting temperature (Tm) is calculated using the formula: $Tm=81.5+16.6(\log [Na^+])+0.41(\text{fraction } G+C)-(600/N)$ where N is the length of the probe.

If the hybridization is carried out in a solution containing formamide, the melting temperature may be calculated using the equation: $Tm=81.5+16.6(\log [Na^+])+0.41(\text{fraction } G+C)-(0.63\% \text{ formamide})-(600/N)$ where N is the length of the probe.

Expression Libraries—Expression libraries can be created using the polynucleotides of the invention in combination with expression vectors and appropriate host cells. The library allows for the in vivo expression of the polypeptides which are encoded by the polynucleotides of the invention. After such expression libraries have been generated one can include the additional step of "biopanning" such libraries prior to screening by cell sorting. The "biopanning" procedure refers to a process for identifying clones having a specified biological activity by screening for sequence identity in a library of clones prepared by (i) selectively isolating target DNA derived from at least one microorganism by use of at least one probe DNA comprising at least a portion of a DNA sequence encoding a polypeptide having a specified biological activity (e.g., nitrilase activity); and (ii) optionally transforming a host with the isolated target DNA to produce a library of clones which are screened for the specified biological activity.

The probe DNA used for selectively isolating the target DNA of interest from the DNA derived from at least one microorganism can be a full-length coding region sequence or a partial coding region sequence of DNA for an enzyme of known activity. The original DNA library can be probed using mixtures of probes comprising at least a portion of DNA sequences encoding enzymes having the specified enzyme activity. These probes or probe libraries are single-stranded and the microbial DNA which is probed has been converted into single-stranded form. The probes that are particularly suitable are those derived from DNA encoding enzymes having an activity similar or identical to the specified enzyme activity that is to be screened.

Having prepared a multiplicity of clones from DNA selectively isolated from an organism, such clones are screened for a specific enzyme activity and to identify the clones having the specified enzyme characteristics.

The screening for enzyme activity may be affected on individual expression clones or may be initially affected on a mixture of expression clones to ascertain whether or not the mixture has one or more specified enzyme activities. If the mixture has a specified enzyme activity, then the individual clones may be rescreened for such enzyme activity or for a more specific activity. Thus, for example, if a clone mixture has nitrilase activity, then the individual clones may be recovered and screened to determine which of such clones has nitrilase activity.

As described with respect to one of the above aspects, the invention provides a process for enzyme activity screening of clones containing selected DNA derived from a microorganism which process includes: screening a library for specified enzyme activity, said library including a plurality of clones, said clones having been prepared by recovering from genomic DNA of a microorganism selected DNA, which DNA is selected by hybridization to at least one DNA sequence which is all or a portion of a DNA sequence encoding an enzyme having the specified activity; and transforming a host with the selected DNA to produce clones which are screened for the specified enzyme activity.

In one aspect, a DNA library derived from a microorganism is subjected to a selection procedure to select therefrom DNA which hybridizes to one or more probe DNA sequences which is all or a portion of a DNA sequence encoding an enzyme having the specified enzyme activity by:

(a) contacting the single-stranded DNA population from the DNA library with the DNA probe bound to a ligand under stringent hybridization conditions so as to produce a duplex between the probe and a member of the DNA library;

(b) contacting the duplex with a solid phase specific binding partner for the ligand so as to produce a solid phase complex;

(c) separating the solid phase complex from the non-duplexed members of the DNA library;

(d) denaturing the duplex to release the member of the DNA library;

(e) creating a complementary DNA strand of the member from step (d) so as to make the member a double-stranded DNA;

(i) introducing the double-stranded DNA into a suitable host so as to express a polypeptide which is encoded by the member DNA; and (g) determining whether the polypeptide expressed exhibits the specified enzymatic activity.

In another aspect, the process includes a preselection to recover DNA including signal or secretion sequences. In this manner it is possible to select from the genomic DNA population by hybridization as hereinabove described only DNA which includes a signal or secretion sequence. The following paragraphs describe the protocol for this aspect of the invention, the nature and function of secretion signal sequences in general and a specific exemplary application of such sequences to an assay or selection process.

A particularly aspect of this aspect further comprises, after (a) but before (b) above, the steps of:

(i) contacting the single-stranded DNA population of (a) with a ligand-bound oligonucleotide probe that is complementary to a secretion signal sequence unique to a given class of proteins under hybridization conditions to form a double-stranded DNA duplex;

(ii) contacting the duplex of (i) with a solid phase specific binding partner for said ligand so as to produce a solid phase complex;

(iii) separating the solid phase complex from the single-stranded DNA population of (a);

(iv) denaturing the duplex so as to release single-stranded DNA members of the genomic population; and (v) separating the single-stranded DNA members from the solid phase bound probe.

The DNA which has been selected and isolated to include a signal sequence is then subjected to the selection procedure hereinabove described to select and isolate therefrom DNA which binds to one or more probe DNA sequences derived from DNA encoding an enzyme(s) having the specified enzyme activity. This procedure is described and exemplified in U.S. Pat. No. 6,054,267, incorporated herein by reference in its entirety.

In vivo biopanning may be performed utilizing a (fluorescence activated cell sorter) FACS-based machine. Complex gene libraries are constructed with vectors which contain elements which stabilize transcribed RNA. For example, the inclusion of sequences which result in secondary structures such as hairpins which are designed to flank the transcribed regions of the RNA would serve to enhance their stability, thus increasing their half life within the cell. The probe molecules used in the biopanning process consist of oligonucleotides labeled with reporter molecules that only fluoresce upon binding of the probe to a target molecule. These probes are introduced into the recombinant cells from the library using one of several transformation methods. The probe molecules bind to the transcribed target mRNA resulting in DNA/RNA heteroduplex molecules. Binding of the probe to a target will yield a fluorescent signal that is detected and sorted by the FACS machine during the screening process.

In some aspects, the nucleic acid encoding one of the polypeptides of the Group B amino acid sequences, sequences substantially identical thereto, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. Optionally, the nucleic acid can encode a fusion polypeptide in which one of the polypeptides of the Group B amino acid sequences, sequences substantially identical thereto, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The host cell may be any of the host cells familiar to those skilled in the art, including prokaryotic cells, eukaryotic cells, mammalian cells, insect cells, or plant cells. As representative examples of appropriate hosts, there may be mentioned: bacterial cells, such as *E. coli, Streptomyces, Bacillus subtilis, Salmonella typhimurium* and various species within the genera *Pseudomonas, Streptomyces,* and *Staphylococcus*, fungal cells, such as yeast, insect cells such as *Drosophila* S2 and *Spodoptera* Sf9, animal cells such as CHO, COS or Bowes melanoma, and adenoviruses. The selection of an appropriate host is within the abilities of those skilled in the art.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman (1981), *Cell* 23:175), and other cell lines capable of expressing proteins from a compatible vector, such as the C127, 3T3, CHO, HeLa and BHK cell lines.

The invention also relates to variants of the polypeptides of the Group B amino acid sequences, sequences substantially identical thereto, or fragments comprising at least 5, 10, 15, 20, 25, 30, 35, 40, 50, 75, 100, or 150 consecutive amino acids thereof. In particular, the variants may differ in amino acid sequence from the polypeptides of the Group B amino acid sequences, and sequences substantially identical thereto, by one or more substitutions, additions, deletions, fusions and truncations, which may be present in any combination.

The variants may be naturally occurring or created in vitro. In particular, such variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures.

Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. Typically, these nucleotide differences result in amino acid changes with respect to the polypeptides encoded by the nucleic acids from the natural isolates.

Error Prone PCR

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described in Leung et al. (1989), *Technique* 1:11-15 and Caldwell et al. (1992), *PCR Methods Applic.* 2:28-33, the disclosures of which are incorporated herein by reference in their entirety. Briefly, in such procedures, nucleic acids to be mutagenized are mixed with PCR primers and reagents (e.g., reaction buffer, $MgCl_2$, $MnCl_2$, Taq polymerase and an appropriate concentration of dNTPs) for achieving a high rate of point mutation along the entire length of the PCR product. For example, the reaction may be performed using 20 fmoles of nucleic acid to be mutagenized, 30 pmoles of each PCR primer, a reaction buffer comprising 50 mM KCl, 10 mM Tris HCl (pH 8.3) and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants also may be created using oligonucleotide directed mutagenesis to generate site-specific mutations in any cloned DNA of interest. Oligonucleotide mutagenesis is described in Reidhaar-Olson et al. (1988), *Science,* 241:53-57, the disclosure of which is incorporated herein by reference in its entirety. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Assembly PCR

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in U.S. Pat. No. 5,965,408, the disclosure of which is incorporated herein by reference in its entirety.

Sexual PCR Mutagenesis

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described in Stemmer (1994), *Proc. Natl. Acad. Sci. USA* 91:10747-10751, the disclosure of which is incorporated herein by reference in its entirety. Briefly, in such procedures a plurality of nucleic acids to be recombined are digested with DNAse to generate fragments having an average size of about 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/µl in a solution of 0.2 mM of each dNTP, 2.2 mM $MgCl_2$, 50 mM KCl, 10 mM Tris HCl, pH 9.0, and 0.1% Triton X-100. 2.5 units of Taq polymerase per 100 µl of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

In Vivo Mutagenesis

Variants may also be created by in vivo mutagenesis. In some aspects, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427 the disclosure of which is incorporated herein by reference in its entirety.

Cassette Mutagenesis

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive Ensemble Mutagenesis

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in Arkin et al. (1992), *Proc. Natl. Acad. Sci. USA,* 89:7811-7815, the disclosure of which is incorporated herein by reference in its entirety.

Exponential Ensemble Mutagenesis

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in Delegrave et al. (1993), *Biotechnology Research* 11:1548-1552, the disclosure of which incorporated herein by reference in its entirety.

Random and Site-Directed Mutagenesis

Random and site-directed mutagenesis is described in Arnold (1993), *Current Opinions in Biotechnology* 4:450-455, the disclosure of which is incorporated herein by reference in its entirety.

Shuffling Procedures

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. Nos. 5,965,408 and 5,939,250, each of which is hereby incorporated by reference in their entireties.

The variants of the polypeptides of the Group B amino acid sequences may be variants in which one or more of the amino acid residues of the polypeptides of the Group B amino acid sequences are substituted with a conserved or non-conserved amino acid residue (e.g., a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of the polypeptides of the Group B amino acid sequences includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of the Group B amino acid sequences, and sequences substantially identical thereto. In other aspects, the fragment, derivative, or analog includes a proprotein, such that the fragment, derivative, or analog can be activated by cleavage of the proprotein portion to produce an active polypeptide.

Another aspect of the invention is polypeptides or fragments thereof which have at least about 85%, at least about 90%, at least about 95%, or more than about 95% homology to one of the polypeptides of the Group B amino acid sequences, sequences substantially identical thereto, or a fragment comprising at least 5, 10, 15, 20, 25, 30, 35, 40, 50, 75, 100, or 150 consecutive amino acids thereof. Percent identity may be determined using any of the programs described above which aligns the polypeptides or fragments being compared and determines the extent of amino acid homology or similarity between them. It will be appreciated that amino acid "homology" includes conservative amino acid substitutions such as those described above. In one aspect of the invention, the fragments can be used to generate antibodies. These antibodies can be used to immobilize nitrilases can be used in industrial processes. Polynucleotides encoding the nitrilases of the present invention can be used in a similar way.

Alternatively, the homologous polypeptides or fragments may be obtained through biochemical enrichment or purification procedures. The sequence of potentially homologous polypeptides or fragments may be determined by proteolytic digestion, gel electrophoresis and/or microsequencing. The sequence of the prospective homologous polypeptide or fragment can be compared to one of the polypeptides of the Group B amino acid sequences, sequences substantially identical thereto, or a fragment comprising at least about 5, 10, 15, 20, 25, 30, 35, 40, 50, 75, 100, or 150 consecutive amino acids thereof using any of the programs described herein.

Another aspect of the invention is an assay for identifying fragments or variants of the Group B amino acid sequences, or sequences substantially identical thereto, which retain the enzymatic function of the polypeptides of the Group B amino acid sequences, and sequences substantially identical thereto. For example, the fragments or variants of the polypeptides, may be used to catalyze biochemical reactions, which indicate that said fragment or variant retains the enzymatic activity of the polypeptides in Group B amino acid sequences.

The assay for determining if fragments of variants retain the enzymatic activity of the polypeptides of the Group B amino acid sequences, and sequences substantially identical thereto includes the steps of: contacting the polypeptide fragment or variant with a substrate molecule under conditions which allow the polypeptide fragment or variant to function, and detecting either a decrease in the level of substrate or an increase in the level of the specific reaction product of the reaction between the polypeptide and substrate.

The polypeptides of the Group B amino acid sequences, sequences substantially identical thereto or fragments comprising at least 5, 10, 15, 20, 25, 30, 35, 40, 50, 75, 100, or 150 consecutive amino acids thereof may be used in a variety of applications. For example, the polypeptides or fragments thereof may be used to catalyze biochemical reactions. In accordance with one aspect of the invention, there is provided a process for utilizing a polypeptide of the Group B amino acid sequences, and sequences substantially identical thereto or polynucleotides encoding such polypeptides for hydrolyzing aminonitriles. In such procedures, a substance containing a haloalkane compound is contacted with one of the polypeptides of the Group B amino acid sequences, and sequences substantially identical thereto under conditions which facilitate the hydrolysis of the compound.

Antibodies—The polypeptides of Group B amino acid sequences, sequences substantially identical thereto or fragments comprising at least 5, 10, 15, 20, 25, 30, 35, 40, 50, 75, 100, or 150 consecutive amino acids thereof, may also be used to generate antibodies which bind specifically to the enzyme polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of the Group B amino acid sequences, sequences substantially identical thereto, or fragments of the foregoing sequences.

In immunoaffinity procedures, the antibody is attached to a solid support, such as a bead or column matrix. The protein preparation is placed in contact with the antibody under conditions under which the antibody specifically binds to one of the polypeptides of the Group B amino acid sequences, sequences substantially identical thereto, or fragments thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays, and Western Blots.

The antibodies of the invention can be attached to solid supports and used to immobilize nitrilases of the present invention. Such immobilized nitrilases can be used, as described above, in industrial chemical processes for the conversion of nitrites to a wide range of useful products and intermediates.

Polyclonal antibodies generated against the polypeptides of the Group B amino acid sequences, and sequences substantially identical thereto, or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein (1975), *Nature,* 256:495-497, the disclosure of which is incorporated herein by reference), the trioma technique, the human B-cell hybridoma technique (Kozbor et al. (1983), *Immunology Today* 4:72, the disclosure of which is incorporated herein by reference), and the EBV-hybridoma technique (Cole et al. (1985), in Monoclonal Antibodies and Cancer Therapy, Alan R. Liss, Inc., pp. 77-96, the disclosure of which is incorporated herein by reference in its entirety).

Techniques described for the production of single chain antibodies (U.S. Pat. No. 4,946,778, the disclosure of which is incorporated herein by reference in its entirety) can be adapted to produce single chain antibodies to the polypeptides of, for example, the Group B amino acid sequences, or fragments thereof. Alternatively, transgenic mice may be used to express humanized antibodies to these polypeptides or fragments.

Antibodies generated against a polypeptide of the Group B amino acid sequences, sequences substantially identical thereto, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind to the antibody are detected. Any of the procedures described above may be used to detect antibody binding. One such screening assay is described in "Methods for Measuring Cellulase Activities", *Methods in Enzymology,* 160:87-116, which is hereby incorporated by reference in its entirety.

Use of Whole Cells Comprising A Nucleic Acid

The invention provides for the use of whole cells which have been transformed with nucleic acid (or an active fragment thereof) encoding one or more of the nitrilases of the invention. The invention also provides for the use of such a whole cell in performing a nitrilase reaction on a substrate. Therefore, this invention provides for methods of hydrolyzing a cyanohydrin or aminonitrile linkage using a whole cell comprising at least one nucleic acid or polypeptide disclosed herein (SEQ ID NOS:1-386). For example, a whole cell which is stably transfected (the invention also encompasses transiently transfected or transformed whole cells) with a nucleic acid encoding a nitrilase is one aspect of the invention. Such a cell is useful as a reagent in a reaction mixture to act on a substrate and exhibit nitrilase activity.

Sequence Analysis Software

Percent identity or homology between two or more sequences is typically measured using sequence analysis software (e.g., Sequence Analysis Software Package of the Genetics Computer Group, University of Wisconsin Biotechnology Center, Madison, Wis.). Such software matches similar sequences by assigning a percent identity or homology to various deletions, substitutions and other modifications. The term "percent identity," in the context of two or more nucleic acids or polypeptide sequences, refers to the percentage of nucleotides or amino acid residues that are the same when compared after being aligned for maximum correspondence over a designated region or comparison "window." Under some algorithms, a conservative amino acid substitution can be considered "identical" and a change at a wobble site of a codon can be considered "identical."

"Alignment" refers to the process of lining up two or more sequences to achieve maximal correspondence for the purpose of assessing the degree of identity or homology, as defined within the context of the relevant alignment algorithm.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated for a particular algorithm. Default program parameters can be used, or alternative parameters can be designated. The sequence comparison algorithm then calculates the percent identity or homology for the test sequences relative to the reference sequence, based on the program parameters.

A "comparison window", as used herein, is a segment of the contiguous positions in a nucleic acid or an amino acid sequence consisting of from 20 to 600, usually about 50 to about 200, more usually about 100 to about 150 nucleotides or residues, which may be compared to a reference sequence of the same or different number of contiguous positions after the two sequences are optimally aligned. Methods of alignment of sequences for comparison are well-known in the art. Optimal alignment of sequences for comparison can be conducted, e.g., by the local homology algorithm of Smith and Waterman (1981), *Adv. Appl. Math.* 2:482, by the homology alignment algorithm of Needleman and Wunsch (1970), *J. Mol. Biol.* 48:443, by the search for similarity method of Pearson and Lipman (1988), *Proc. Natl. Acad. Sci. USA* 85:2444-2448, by computerized implementations of these algorithms, or by manual alignment and visual inspection.

Other algorithms for determining homology or identity include, for example, the BLAST program (Basic Local Alignment Search Tool, National Center for Biological Information), BESTFIT, FASTA, and TFASTA (Wisconsin Genetics Software Package, Genetics Computer Group, Madison, Wis.), ALIGN, AMAS (Analysis of Multiply Aligned Sequences), AMPS (Alignment of Multiple Protein Sequence), ASSET (Aligned Segment Statistical Evaluation Tool), BANDS, BESTSCOR, BIOSCAN (Biological Sequence Comparative Analysis Node), BLIMPS (BLocks IMProved Searcher), Intervals and Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction and Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project. At least twenty-one other genomes have already been sequenced, including, for example, *M. genitalium* (Fraser et al., 1995), *M. jannaschii* (Bult et al., 1996), *H. influenzae* (Fleischmann et al., 1995), *E. coli* (Blattner et al., 1997), and yeast (*S. cerevisiae*) (Mewes et al., 1997), and *D. melanogaster* (Adams et al., 2000). Significant progress has also been made in sequencing the genomes of model organism, such as mouse, *C. elegans*, and *Arabadopsis* sp. Several databases containing genomic information annotated with some functional information are maintained by different organizations.

Examples of useful algorithms are the BLAST and the BLAST 2.0 algorithms, which are described in Altschul et al. (1977), *Nuc. Acids Res.* 25:3389-3402, and Altschul et al. (1990), *J. Mol. Biol.* 215:403-410, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using the parameter M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. For nucleotide sequences, the BLASTN program uses as defaults a wordlength (W) of 11, an expectation (E) of 10, M=5, N=−4 and a comparison of both strands. For amino acid sequences, the BLASTP program uses as defaults a wordlength (W) of 3, an expectation (E) of 10, and the BLOSUM62 scoring matrix (see Henikoff and Henikoff (1989), *Proc. Natl. Acad. Sci. USA* 89:10915).

The BLAST algorithm also performs a statistical analysis of the similarity between two sequences (see, e.g., Karlin and Altschul (1993), *Proc. Natl. Acad. Sci. USA* 90:5873). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, less than about 0.01, or less than about 0.001.

In one aspect, protein and nucleic acid sequence homologies are evaluated using the Basic Local Alignment Search Tool ("BLAST"). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which may be obtained from a protein or nucleic acid sequence database. High-scoring segment pairs are identified (i.e., aligned) by means of a scoring matrix, many of which are known in the art. In one example, the scoring matrix used is the BLOSUM62 matrix (Gonnet et al. (1992), *Science* 256:1443-1445; Henikoff and Henikoff (1993), *Proteins* 17:49-61). In another example, the PAM or PAM250 matrices may also be used (see, e.g., Schwartz and Dayhoff, eds. (1978), Matrices for Detecting Distance Relationships: Atlas of Protein Sequence and Structure, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library which exhibits a desired activity. A specific biocatalytic reaction which produces the modified small molecule of desired activity is identified by systematically eliminating each of the biocatalytic reactions used to produce a portion of the library, and then testing the small molecules produced in the portion of the library for the presence or absence of the modified small molecule with the desired activity. The specific biocatalytic reactions, which produce the modified small molecule of, desired activity is optionally repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

Some aspects of the use of the nitrilases are:

α-hydroxy acid—Nitrilases produce α-hydroxy acids through hydrolysis of cyanohydrins. Production of mandelic acid and derivatives thereof is an example of this. A significant application of this type involves commercial production of (R)-mandelic acid in both high yield and high enantioselectivity from mandelonitrile. Mandelic acid and derivatives have found broad application as intermediates and resolving agents for the production of many chiral pharmaceutical and agricultural products. Previous attempts to employ the few known nitrilases in processes using analogous substrates have been plagued by significantly lower activity, productivity, and selectivity.

Phenyllactic Acid Derivatives

An additional application is in the production of (S)-phenyl lactic acid derivatives in both high yield and high enantioselectivity. Phenyl lactic acid derivatives have found broad application in the production of many chiral pharmaceutical and agricultural products.

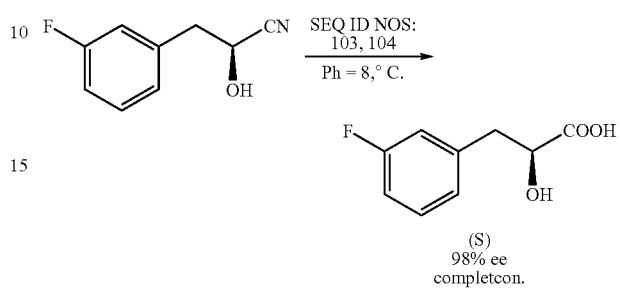

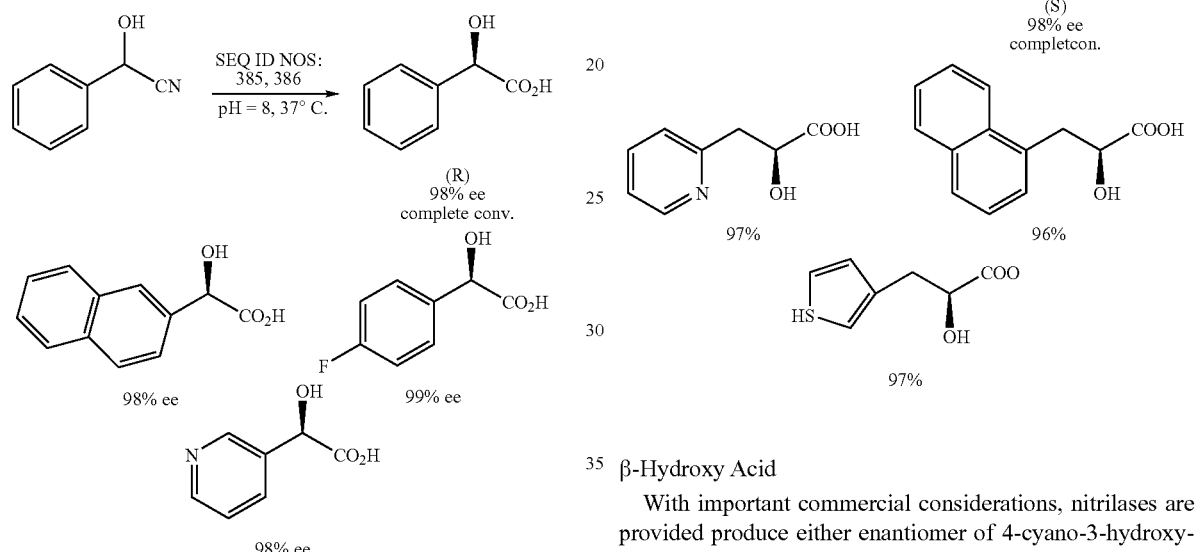

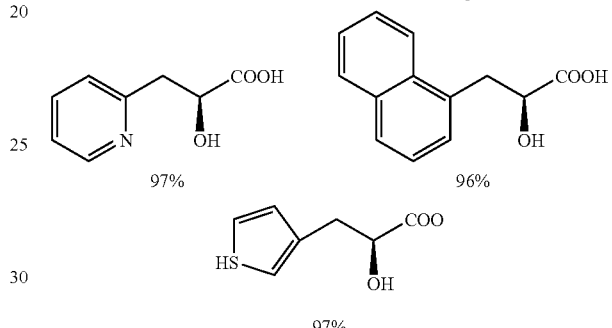

β-Hydroxy Acid

With important commercial considerations, nitrilases are provided produce either enantiomer of 4-cyano-3-hydroxy-butyric acid, the (R)-enanatiomer of which is a key intermediate in the synthesis of the drug LIPITOR™.

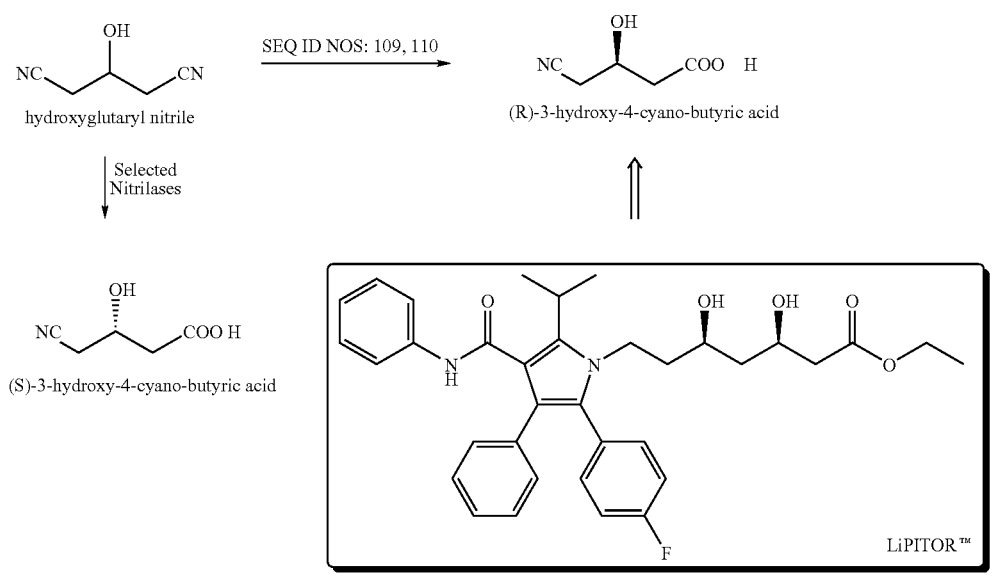

The following nitrilases are more examples of nitrilases useful in converting hydroxyglutarylnitrile to (R)-3-hydroxy-4-cyano-butyric acid: SEQ ID NOS:205, 206, SEQ ID NOS:207, 208, SEQ ID NOS:195, 196, SEQ ID NOS:43, 44, SEQ ID NOS:321, 322, and SEQ ID NOS:237, 238. The above schematic indicates that "selected nitrilases" can be used to convert hydroxyglutarylnitrile to (S)-3-hydroxy-4-cyano-butyric acid: SEQ ID NOS:107, 108, SEQ ID NOS:109, 110, SEQ ID NOS:111, 112, SEQ ID NOS:127, 128, SEQ ID NOS:129, 130, SEQ ID NOS:133, 134, SEQ ID NOS:113, 114, SEQ ID NOS:145, 146, SEQ ID NOS:101, 102, SEQ ID NOS:179, 180, SEQ ID NOS:201, 202, SEQ ID NOS:159, 160, SEQ ID NOS:177, 178, SEQ ID NOS:181, 182, SEQ ID NOS:183, 184, SEQ ID NOS:185, 186, SEQ ID NOS:57, 58, SEQ ID NOS:197, 198, SEQ ID NOS:59, 60, SEQ ID NOS:67, 68, and SEQ ID NOS:359, 360.

The invention will be further described with reference to the following examples; however, it is to be understood that the invention is not limited to such examples. Rather, in view of the present disclosure which describes the current best mode for practicing the invention, many modifications and variations would present themselves to those of skill in the art without departing from the scope and spirit of this invention. All changes, modifications, and variations coming within the meaning and range of equivalency of the claims are to be considered within their scope.

EXAMPLES

Example 1

Phagemid Infections

For each library to be screened for nitrilases, an infection was set up as follows: 5 ml of an $OD_{600}nm=1$ resuspension of SEL700 cells and 1 ml of the phagemid library to be screened were combined. The combination was incubated in a 37° C. waterbath for 45 min.

Using the infection, serial dilutions were made in 10 mM $MgSO_4$, using 10 µl aliquots of the infection.

| titer of library | dilutions to make |
|---|---|
| ~$10^5$ cfu/ml | $10^{-1}$ dilution |
| ~$10^6$ cfu/ml | $10^{-1}$, $10^{-2}$ dilution |
| ~$10^7$ cfu/ml | $10^{-1}$, $10^{-2}$, $10^{-3}$ dilution |

60 µl of each of the following dilutions were deposited onto a small LB-kan$^{50}$ plate:

| titer of library | dilutions to make |
|---|---|
| ~$10^5$ cfu/ml | undiluted infection, $10^{-1}$ dilution |
| ~$10^6$ cfu/ml | $10^{-1}$, $10^{-2}$ dilutions |
| ~$10^7$ cfu/ml | $10^{-2}$, $10^{-3}$ dilutions |

The cells in the infection were centrifuged in a tabletop centrifuge at 4° C., 4.6 k rpm, 10 min to form pellets. The supernatant was decanted from the resulting pellets. The cells were resuspended in residual liquid. All of the resuspended cells were deposited onto a single large LB-kan$^{50}$ plate. All plates were incubated at 30° C. overnight.

Example 2

Selection Screenings

The cells of each infection plate were resuspended with ~4 mls 10 mM $MgSO_4$. The resuspensions were placed in a tube. The remaining cells on each plate were resuspended with ~3 mls 10 mM $MgSO_4$ and combined with the first resuspension from the same plate. The volume of each tube was brought to 12 ml with 10 mM $MgSO_4$. The tubes were vortexed vigorously. The tubes were centrifuged in a tabletop centrifuge at 4° C. and 4.6 k for 10 min to form pellets. The supernatant was decanted from each resuspension. The washed cells in each tube were resuspended with 10 ml 10 mM $MgSO_4$. The resuspensions from each library were stored at 4° C. until the selection cultures were ready to be set up.

For each resuspension, selection cultures were set up using the following process:
1) The nitrilase selection medium was prepared, using: 1×M9 medium with 0.2% glucose, no nitrogen and 50 µg/ml kanamycin (for pBK phagemid libraries only; use ampicillin for pBS libraries).
2) 5 ml of the medium was aliquoted into a 50 ml screw top conical tube.
3) 25 µl of the stored resuspension was added to the tube.
4) 5 µl of adiponitrile was added to the tube, to bring the final concentration to 8.8 mM. Additional nitrile substrates may be used, in place of adiponitrile.
5) The resulting combination was cultured at 30° C.

Steps 1-5 were repeated for each nitrile substrate.

Example 3

Isolation of a Positive Nitrilase Clone from Selection Cultures

Ten (10) µl of selection culture with growth was streaked out onto a small LB-kan$^{50}$ plate and allowed to grow for 2 nights at 30° C. Five isolated cfu were picked and each was grown in 2 ml nitrilase selection medium at 30° C. Each culture was monitored (where growth indicates positive cfu was picked), and was removed when monitoring indicated that it was in a stationary phase of growth. One (1) ml of culture was used to do a plasmid preparation and was eluted with 40 µl elution buffer. Five to eight (5-8) µl DNA was cut with Pst I/Xho I or Sac I/Kpn I restriction enzymes to remove insert from vector. A restriction fragment length polymorphism (RFLP) determination was carried out to identify the size of the insert. The insert was sequenced.

Example 4

Screening and Characterization of Nitrilases

Nitrilases of the invention were screened against target substrates. Of those showing hydrolytic activity in a primary screen, enzymes with enantioselectivities above 20% enantiomeric excess (ee) were selected for further characterization. Those enzymes were selected based on: 1) having activity against one of the substrates of interest and 2) exhibition of greater than 35% ee (enantiomeric excess). The results of this screening process are set forth in Table 1 above. The products used for screening were: D-Phenylglycine, L-Phenyllactic acid, (R) 2-chloromandelic acid, (S)-Cyclohexylmandelic acid, L-2-methylphenylglycine, (S)-2-amino-6-hydroxy hexanoic acid, and 4-methyl-L-leucine.

Screening of Nitrilases Against Target Substrate D-Phenylglycine

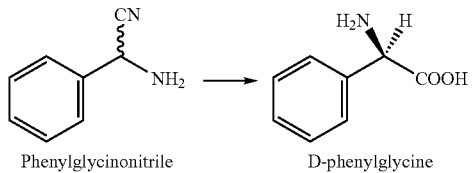

Phenylglycinonitrile    D-phenylglycine

The hydrolysis of phenylglycinonitrile was performed. Some of these enzymes showed an ee higher than 20% and those were selected for preliminary characterization.

Based on the preliminary characterization experiments, a number of putative hits were identified on phenylglycinonitrile and a large amount of data was accumulated on these enzymes. The data revealed many common properties: the majority of the enzymes had pH optima for activity at pH 7 and, in general, the enantioselectivity was enhanced at the lower pH values. The enzymes were found to be more active at higher temperature, particularly 38° C., although this temperature often resulted in lower enantioselectivities. The use of water-miscible co-solvents in the reaction was shown to be a practical option. The inclusion of 10-25% methanol (v/v) in the enzyme reactions did not substantially affect enzyme activity and in many cases, led to an increase in enantioselectivity. The use of biphasic systems has also shown some promise, with the enzymes maintaining their level of activity with the addition of up to 70% (v/v) of hexane and, in some cases, toluene. The use of ethyl acetate in the biphasic systems, however, led to lower activity.

Of the enzymes identified active on phenylglycinonitrile, the enantioselectivity of several enzymes was shown to remain above the success criterion of 35% ee. The preliminary characterization data indicated that some of the enzymes exhibited high enantioselectivities for D-phenylglycine, with corresponding conversion to product of 40-60%. Further investigation suggested that the rate of activity of some of these enzymes was faster than the rate of racemization of the substrate. Reducing the concentration of enzyme led to improved enantioselectivity; therefore, it appears that some benefit could be gained by control of the relative rates of the chemical racemization and the enzyme activity.

Screening of Nitrilases Against Target Substrate (R)-2-Chloromandelic Acid

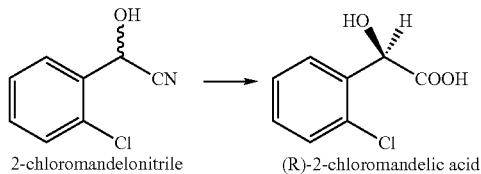

2-chloromandelonitrile    (R)-2-chloromandelic acid

Enzymes were identified which showed activity on 2-chloromandelonitrile. A high degree of overlap existed between the enzymes which were active on 2-chloromandelonitrile and phenylglycinonitrile. Many of these enzymes also formed a distinct sequence family.

Higher temperatures and neutral pH appeared to lead to the highest activity for the active enzymes. For the majority of the nitrilases, the enantioselectivity also increased at higher temperatures, particularly 38° C. The enzymes retained their activity in the presence of up to 25% methanol or 10% isopropanol; in many of these cases, the enantioselectivity was also enhanced. Activity in biphasic systems was largely comparable to aqueous conditions, particularly with hexane as the non-aqueous phase; varying tolerances to toluene were observed between the different nitrilases.

TABLE 2

Summary of optimal conditions determined from characterization experiments for enantioselective hydrolysis of 2-chloromandelonitrile.

| SEQ ID NOS: | Optimum pH | Optimum Temp ° C. | Solvent Tolerance |
|---|---|---|---|
| 385, 386 | 7 | 38 | 25% MeOH |
| 169, 170 | 5 | 38 | 25% MeOH, 10% IPA |
| 185, 186 | 7 | 38 | 25% MeOH, 10% IPA |
| 47, 48 | 7 | 38 | 10% MeOH |
| 197, 198 | 6 | 55 | 25% MeOH, 10% IPA |
| 187, 188 | 7 | 38 | 10% MeOH; 40% IPA |
| 217, 218 | 7 | 38 | 25% MeOH, 10% IPA, 70% hexane, 40% toluene |
| 55, 56 | 7 | 38 | 10% MeOH, EPA, 70% hexane |
| 167, 168 | 9 | 38 | 10% MeOH, EPA, 70% hexane |
| 15, 16 | 7 | 38 | 25% MeOH, 10% IPA, 70% hexane, 40% toluene |

Screening of Nitrilases Against Target Substrate (S)-Phenyllactic Acid:

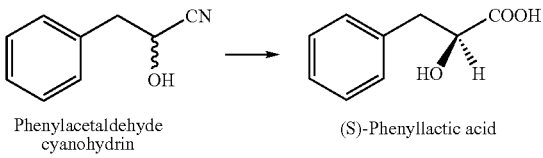

Phenylacetaldehyde cyanohydrin    (S)-Phenyllactic acid

Many of the nitrilases tested were active on phenaylacetaldehyde cyanohydrin. Many of these enzymes were part of two related sequence families and were distinct from those enzymes that were active on phenylglycinonitrile and chloromandelonitrile.

The pH optima of the enzymes was generally above pH 7 (i.e. pH 8 or 9), with higher enantioselectivities being exhibited at these levels. Most of the enzymes showed superior activity at higher temperature, particularly 38° C. The effect of temperature on the enantioselectivities of the enzymes varied; in most cases, this property was slightly lower at higher temperatures. While the enzymes were tolerant towards the addition of co-solvents, particularly 10% (v/v) methanol, no advantage in activity or enantioselectivity was gained by such additions. The use of a biphasic system was again shown to be feasible.

TABLE 3

Summary of optimal conditions determined from characterization experiments for enantioselective hydrolysis of phenylacetaldehyde cyanohydrin

| SEQ ID NOS: | Optimum pH | Optimum Temp ° C. | Solvent Tolerance |
|---|---|---|---|
| 103, 104 | 7 | 55 | 10% MeOH, IPA |
| 99, 100 | 8 | 38 | 10% MeOH, 70% hexane, toluene |
| 183, 184 | 9 | 38 | 10% MeOH, IPA, 70% toluene, hexane |
| 173, 174 | 5 | 38-55 | 25% MeOH, IPA, 70% hexane, toluene |
| 213, 214 | 7 | 38 | 10% MeOH, 25% IPA, 70% hexane, toluene |
| 61, 62 | 7 | 38 | 10% MeOH, 70% hexane, toluene |
| 205, 206 | 8 | 38-55 | 10% MeOH, IPA, 40% hexane, toluene |
| 207, 208 | 8 | 38 | 10% MeOH, 70% hexane |
| 309, 210 | 8 | 38 | 10% MeOH, 40% hexane, toluene |
| 195, 196 | 8 | 38 | 10% MeOH, 40% hexane, toluene |
| 43, 44 | 9 | 38 | 10% MeOH, 40% hexane |
| 161, 162 | 9 | 38 | 25% MeOH, IPA, 10% hexane, toluene |
| 175, 176 | 6 | 38-55 | 10% MeOH, IPA, 40% hexane |
| 293, 294 | 6 | 38 | 10% MeOH, IPA, 40% hexane |

Screening of Nitrilases Against Target Substrate L-2-Methylphenylglycine

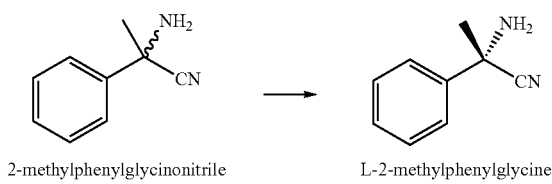

2-methylphenylglycinonitrile → L-2-methylphenylglycine

Nitrilases have shown activity on this substrate and preferentially yielded the D-2-methylphenylglycine, rather than the required L-2-methylphenylglycine.

Screening of Nitrilases Against Target Substrate L-Hydroxynorleucine ((S)-2-Amino-6-Hydroxy Hexanoic Acid)

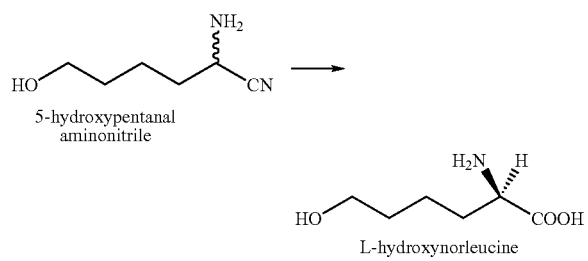

5-hydroxypentanal aminonitrile → L-hydroxynorleucine

A number of nitrilases, which showed activity on 2-amino-6-hydroxy hexanenitrile, were isolated. All of these enzymes showed enantioselectivity towards the L-isomer of the product.

The enzymes all showed higher enantioselectivities at higher pH and appeared to more susceptible to the addition of solvents than the other nitrilases tested. Although activity was detected in the presence of organic solvents, it was generally lower than that of the aqueous control. Once again, the activity of the enzymes was negatively affected by the acid product and aldehyde starting material.

TABLE 4

Summary of optimal conditions determined from characterization experiments for enantioselective hydrolysis of 2-amino-6-hydroxy hexanenitrile.

| SEQ ID NOS: | Optimum pH | Optimum Temp ° C. | Solvent |
|---|---|---|---|
| 217, 218 | 9 | 38 | 10% MeOH |
| 55, 56 | 9 | 38 | None |
| 187, 188 | 9 | 38 | 10% MeOH |
| 167, 168 | 9 | 38 | None |
| 221, 222 | 9 | 38 | |

A range of hydrolytic activities was observed among the confirmed hit enzymes for 2-amino-6-hydroxy hexanenitrile.

Screening of Nitrilases Against Target Substrate 4-Methyl-D-Leucine and 4-Methyl-L-Leucine

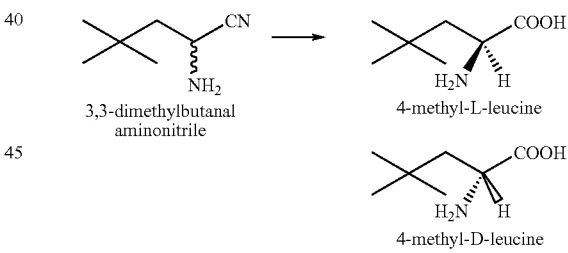

3,3-dimethylbutanal aminonitrile → 4-methyl-L-leucine / 4-methyl-D-leucine

Hydrolysis of 2-amino-4,4-dimethyl pentanenitrile was performed by several of the nitrilases. Of these, some were shown to hydrolyse the nitrile to the L-isomer of the corresponding acid and were selected for further characterization.

TABLE 5

Summary of optimal conditions determined from characterization experiments for enantioselective hydrolysis of 2-amino-4,4-dimethyl pentanenitrile

| SEQ ID NOS: | Optimum pH | Optimum Temp ° C. | Solvent Tolerance |
|---|---|---|---|
| 103, 104 | 7 | 23 | 25% MeOH, 10% IPA |
| 59, 60 | 8 | 23 | 25% MeOH |
| 221, 222 | 6 | 38 | 25% MeOH, 10% IPA |

Screening of Nitrilases Against Target Substrate (S)-Cyclohexylmandelic Acid

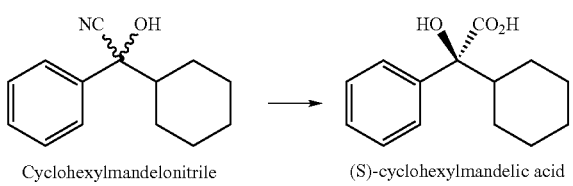

Cyclohexylmandelonitrile → (S)-cyclohexylmandelic acid

Screening of Nitrilases Against Target Substrate Mandelonitrile

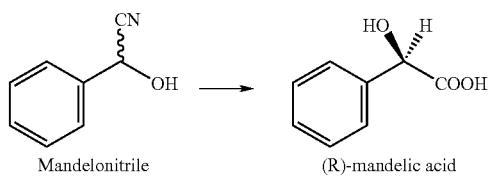

Mandelonitrile → (R)-mandelic acid

The nitrilase collection was also screened on mandelonitrile. The nitrilases actively hydrolyzed both phenylglycinonitrile and chloromandelonitrile.

Enzymatic Assay for Determination of Enantioselectivity

In the design of a spectroscopic system for determination of the chiral α-hydroxy acids and α-amino acids, an enzyme based assay which permits the detection of product formation and enantioselectivity was developed and used.

Figure 6A:
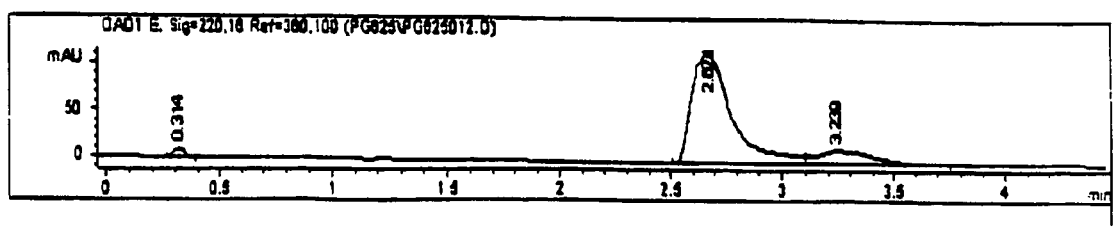
FIGS. 6A-6E are chromatograms characteristic of the substrate and product combination for D-phenylglycine showing a blank sample (FIG. 6A), an enzymatic reaction sample (FIG. 6B); a negative control consisting of cell lysate in buffer (FIG. 6C); a chiral analysis of phenylglycine (FIG. 6D); and coelution of the nitrile peak with the D-enantiomer (FIG. 6E).
Figure 6B:
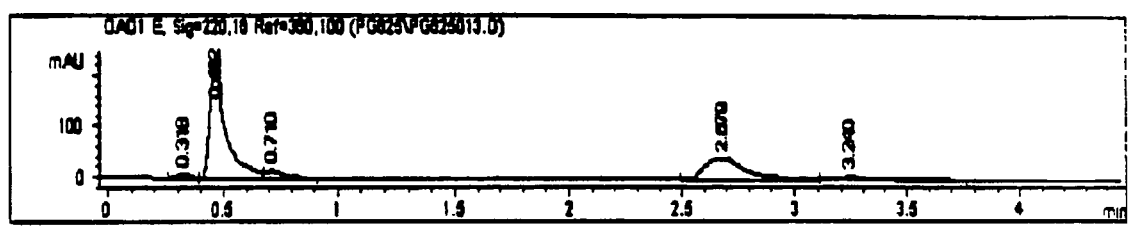
Figure 6C:
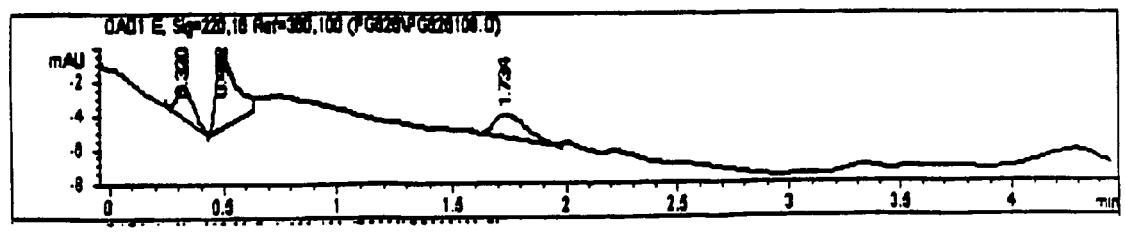
Figure 6D:
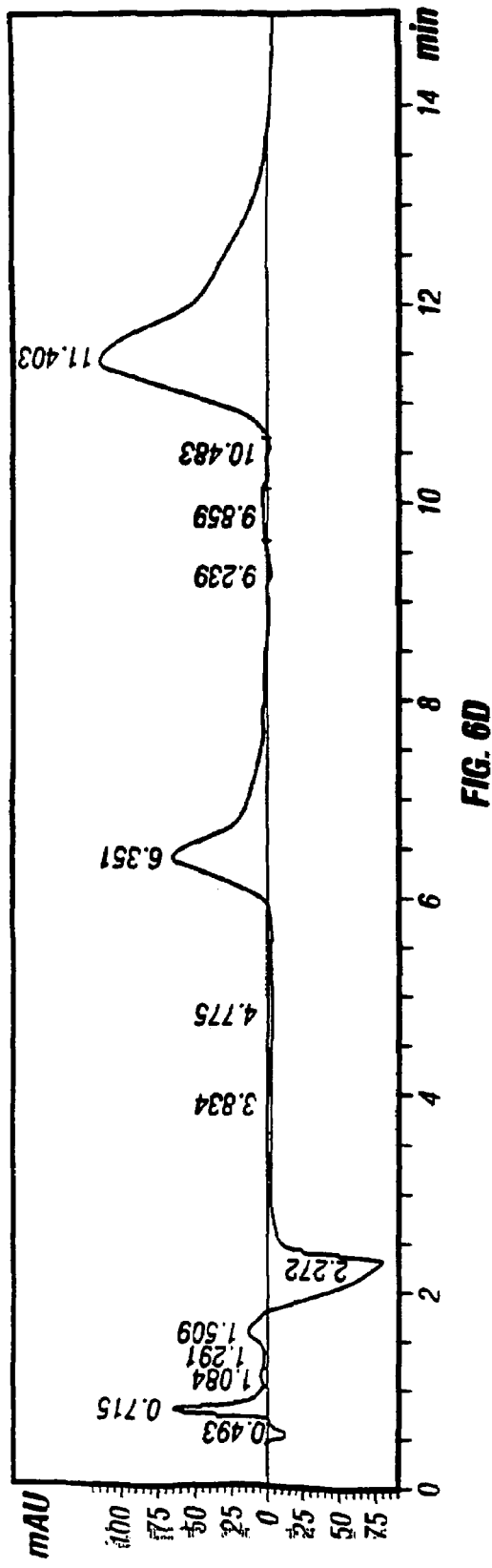
Figure 6E:
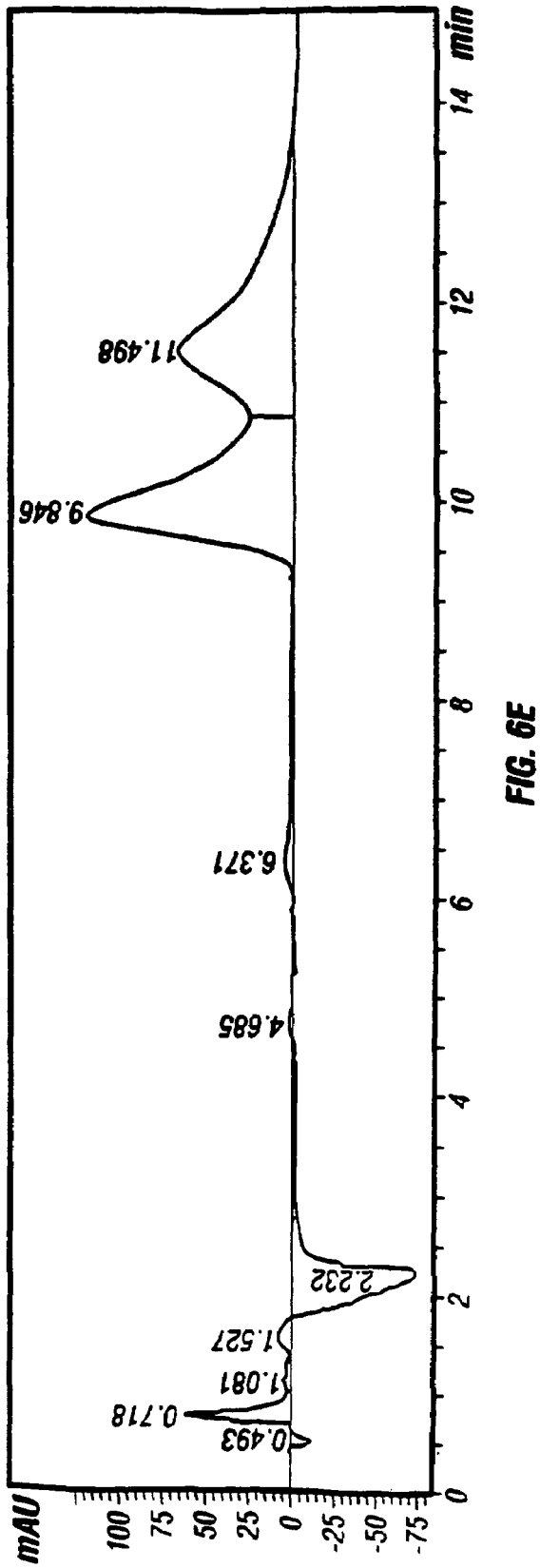
Figure 7E:
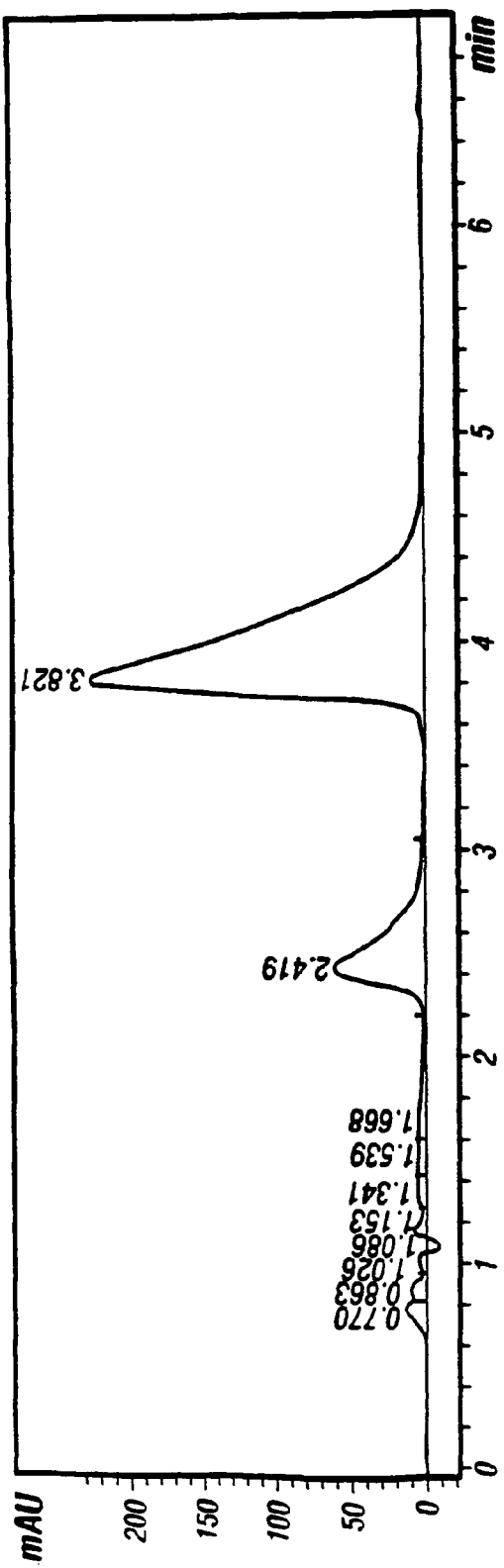

Spectroscopic systems for the detection of α-hydroxy- and for α-amino-acids based on lactate dehydrogenase (L-LDH & D-LDH) and on amino acid oxidase (L-AA Oxid & D-AA Oxid) are described in FIGS. 6 and 7. These enzymes were chosen because they are reported to have reasonably broad substrate ranges while still retaining near absolute enantiospecificity.

The overall feasibility of this system has been established (Table 12). Neither the parent hydroxynitrile nor the aminonitrile is metabolized by the secondary or detection enzyme and thus starting material does not interfere. Cell lysate which is not heat treated results in background activity for the LDH system; however, heat inactivation eliminates the background activity. Cell lysate does not appear to interfere in the AA Oxidase assay. One concern is the inactivation of the AA Oxidase, which utilizes a FMN co-factor, by residual cyanide. However, the control studies indicated that at 2 mM PGN (which could release up to 2 mM HCN) inactivation is not a problem. This assay is suitable for automation of 384 well (or possibly greater density) microtiter plates.

TABLE 6

Summary of Identification of Secondary Enzyme to Chiral Detection of Acid Product.

| SUBSTRATE | ENZYNE WITH SUITABLE ACTIVITY FOUND FROM COMMERCIAL SOURCE |
|---|---|
| Hydroxy Acid Products: | |
| L-lactic acid | YES |
| D-lactic acid | YES |
| L-phenyl lactic acid | YES |
| D-phenyl lactic acid | YES |

TABLE 6-continued

Summary of Identification of Secondary Enzyme to Chiral Detection of Acid Product.

| SUBSTRATE | ENZYNE WITH SUITABLE ACTIVITY FOUND FROM COMMERCIAL SOURCE |
|---|---|
| S-cyclohexylmandelic acid[1] | Not applicable |
| R-cyclohexylmandelic acid[1] | Not applicable |
| Amino Acid Products: | |
| 4-methyl-L-leucine | YES |
| 4-methyl-L/D-leucine | YES (D-unknown) |
| D-phenylalanine | YES |
| R-phenylglycine | YES |
| L-homophenyllactic acid | YES |
| D-homophenyllactic acid | YES |
| L-homophenylalanine | YES |
| D-homophenylalanine | YES |
| (S)-2-amino-6-hydroxy hexanoic acid | YES |
| (R/S)-2-amino-6-hydroxy hexanoic acid | YES (D-unknown) |
| L-methylphenylglycine[1] | 1. Not Applicable |
| D-methylphenylglycine[1] | Not Applicable |

[1]The assay will not be applicable to cyclohexylmandelic acid and 2-methylphenylglycine, as tertiary alcohols are not amenable to this particular oxidation Example 5

Standard Assay Conditions

The following solutions were prepared:

Substrate stock solution: 50 mM of the aminonitrile substrate in 0.1 M phosphate buffer (pH 7) or 50 mM of the cyanohydrin substrate in 0.1 M Na Acetate buffer (pH 5)

Enzyme stock solution: 3.33 ml of 0.1 M phosphate buffer (pH 7) to each vial of 20 mg of lyophilized cell lysate (final concentration 6 mg protein/ml)

Procedure:

Add 100 μl of the 50 mM substrate solution to the appropriate number of wells of a 96-well plate Add 80 μl of buffer to each well Add 20 μl of enzyme solution to each well Blank controls were set up by substitution of 20 μl of buffer for the enzyme solution Negative controls consisting of 20 μl of enzyme solution in 180 μl of buffer were also included in many of the experiments. Once it had been established that the cell lysate did not interfere with the detection of the products, these controls were not included.

Sampling of Reactions:

The reactions were sampled by removing an aliquot from each well (15-50 μl) and diluting the samples as follows:

Samples for Non-Chiral HPLC Analysis:

Phenylglycine, 2-chloromandelic acid and phenyllactic acid: initially, the samples were diluted 2-fold with water and a further 2-fold with methanol or acetonitrile (final dilution: 4-fold). It was found that an 8-fold dilution of these samples led to improved chromatographic separation (S)-2-amino-6-hydroxy hexanoic acid, 4-methylleucine, t-leucine, 2-methylphenylglycine and cyclohexylmandelic acid: samples were diluted 1:1 with methanol or acetonitrile. The choice of solvent was based on the solvent used in the HPLC analysis method.

Samples for Chiral HPLC Analysis:

Phenylglycine, 2-chloromandelic acid and phenyllacetic acid: as described above for the non-chiral analyses, the samples for chiral analyses were initially diluted 2-fold and in the later stages of the project, at 4-fold.

(S)-2-amino-6-hydroxy hexanoic acid, 4-methylleucine, t-leucine, 2-methylphenylglycine: samples were diluted 1:1 with methanol or acetonitrile.

For each experiment, a standard curve of the product was included in the HPLC run. The curve was plotted on an X-Y axis and the concentration of product in the samples calculated from the slope of these curves.

For the preliminary characterization experiments, samples were taken such that the activity of the enzymes was in the linear phase; this was performed so that differences in the effects of the parameters on the rate of reaction, rather than the complete conversion, could be determined. The sampling times are denoted in the tables included in the text.

The samples were analyzed by HPLC, using the methods outlined in Table 20 and 21.

Example 6

Determination of the Effect of pH on Enzyme Activity and Enantioselectivity

The effect of pH on the enzyme activity and enantioselectivity was studied by performance of the standard assay in a range of different buffers:

0.1 M Citrate Phosphate pH 5
0.1 M Citrate Phosphate pH 6
0.1 M Sodium Phosphate pH 7
0.1 M Tris-HCl pH 8
M Tris-HCl pH 9

The samples were analyzed by non-chiral and chiral HPLC methods and examples of the results are presented in Tables 5, 8 and 11 herein.

Example 7

Determination of the Effect of Temperature on Enzyme Activity and Enantioselectivity The effect of temperature on the activity and enantioselectivity was investigated by performing the standard assay at room temperature, 38° C. and 55° C. The samples were analyzed by non-chiral and chiral HPLC methods and examples of the results are given in Tables 5, 8 and 11 herein.

Example 8

Determination of the Effect of Solvents on Enzyme Activity and Enantioselectivity The enzyme reactions were performed in the presence of cosolvents and as biphasic systems, in order to investigate the effect of water-miscible and water-immiscible solvents on the enzymes. In the presence of cosolvents, the reactions were run under standard conditions, with substitution of the buffer with methanol or isopropanol. The final concentrations of solvent in the reactions was 0, 10, 25 and 40% (v/v).

The biphasic reactions were also carried out under standard conditions, with a layer of water-immiscible organic solvent forming the nonaqueous phase. The solvent was added at the following levels: 0%, 10%, 40% and 70% (v/v) of the aqueous phase. The samples from these reactions were evaporated by centrifugation under vacuum and redissolved in a 50:50 mixture of methanol or acetonitrile and water. The samples were analyzed by non-chiral and chiral HPLC methods.

Example 9

Determination of the Effect of Process Components on Enzyme Activity and Enantioselectivity Activity The effect of the process components on the activity of the enzymes was established by addition of the individual components to the enzymatic reaction. These components included the starting materials for the nitrile synthesis, aldehyde, cyanide and ammonium, as well as triethylamine, which is added in catalytic amounts to the nitrile synthesis reaction. The concentrations of the reactants were selected with possible process conditions in mind and were adapted to the levels of reactants used in the enzyme assays. In some cases, the solubility of the aldehydes and products was relatively low; in these cases, the highest level of solubility was added to the reactions as the highest level and 10% of this level as the lower value.

The enzymatic reactions were carried out under standard conditions, with addition of one or more of the following components: benzaldehyde, phenylglycine, phenylacetaldehyde, phenyllacetic acid, 2-chlorobenzaldehyde, 2-chloromandelic acid, 5-hydroxypentanal, (S)-2-amino-6-hydroxy hexanoic acid, 4-methylleucine, KCN, Triethylamine, $NH_4Cl$. Control reactions were performed under standard conditions, with no additive. The samples were analyzed by non-chiral HPLC.

Stability

The stability of the enzymes to process conditions was monitored by incubation of the enzymes in the presence of the individual reaction components for predetermined time periods, prior to assay of the enzyme activity under standard conditions. In these experiments, the enzymes were incubated at a concentration of 1.2 mg protein/ml in the presence of each of the following reaction components: methanol, benzaldehyde, phenylglycine, phenylacetaldehyde, phenyllacetic acid, 2-chlorobenzaldehyde, 2-chloromandelic acid, 5-hydroxypentanal, (S)-2-amino-6-hydroxy hexanoic acid, KCN, $NH_4Cl$.

Assay Conditions:

At 0, 2, 6 and 24 hours of incubation in the particular additive, 50 µl of the enzyme solution was removed, 50 µl of a 50 mM substrate stock solution added and the enzyme activity assayed under standard conditions. After substrate addition, the reactions were sampled at the following times: Phenylglycinonitrile: 10 mins; Phenylacetaldehyde cyanohydrin: 1 hour; 2-chloromandelonitrile: 2 hours. Control reactions were performed by incubation of the enzyme in buffer only. The samples were analyzed using non-chiral HPLC methods.

Example 10

Confirmation of Putative Hit Enzymes

Following the preliminary characterization experiments, the enzymes which were identified as putative hits were assayed under the optimal conditions determined, in order to evaluate their performance, especially in terms of enantioselectivity, when higher conversions were attained. The enzymes were assayed with 25 mM substrate, under the con-

Example 11

Selected Examples of Chromatograms from Enzyme Reactions

In this section, representative examples of chromatograms for each substrate and product combination will be shown, together with a discussion of some of the challenges encountered with the methods and how they were addressed.

D-Phenylglycine

Figure 8A:
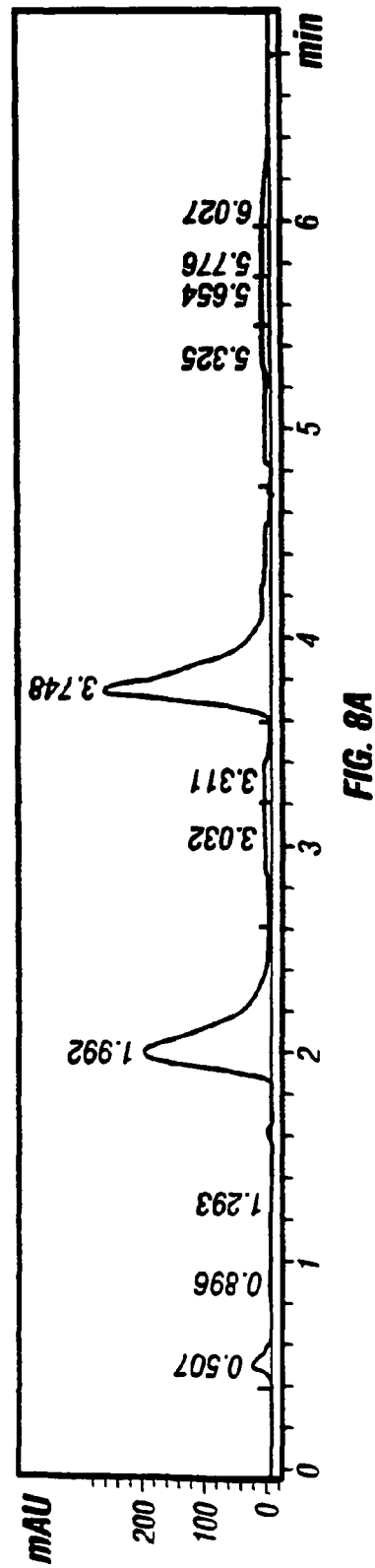

Non-chiral analysis showing the substrate peak eluting at 2.6 min and 3.2 min. See FIGS. 8A-8E. The two peaks were present in all samples containing higher concentrations of the nitrile; the second peak is thought to be a product associated with the nitrile; it decreased with time and was no longer present once complete conversion to the product had taken place. The chromatogram shown in FIG. 8A is a blank control, containing only nitrile and buffer; the samples were all diluted with water and solvent as explained in section 1 above. This was repeated for all samples discussed below. An enzymatic reaction sample is shown in the chromatogram in FIG. 8B, with the product eluting at 0.4 min.

Of note in these chromatograms is the small solvent front peak eluting at 0.3 min. Further representation of this peak is given in the chromatogram shown in FIG. 8C, in which a negative control consisting of cell lysate in buffer, was run. A very small peak coeluted with the product at 0.4 min. In the initial phase of the project, this peak was regarded as problematic, although the appropriate controls were run with each experiment for in order to maintain accuracy. In these experiments, the peak area resulting from the cell lysate, although it was relatively small, was subtracted from the peak areas of the product in the enzymatic reactions. Improvement of this analysis was obtained by further dilution of the samples and the use of lower injection volumes on the HPLC. Following the implementation of these improvements, interference by this peak was shown to be minimal, as shown in the chromatogram illustrated in FIG. 6C.

The chiral analysis of phenylglycine is shown in chromatogram in FIG. 6D with the L-enantiomer eluting at 6 min and the D-enantiomer at 11 min. Good resolution between the two isomers was obtained. However, the column used was very sensitive and the characteristics of the column appeared to change over time, resulting in changes in the elution times of the acids. While this was easily detected by the use of the proper controls and standards, a greater problem existed in the coelution of the nitrile peak with the D-enantiomer (chromatogram shown in FIG. 6E). The cause of this coelution was unclear; however, it was easily detected by the use of appropriate standards; in addition, the UV spectrum of the acid was very distinctive, making the use of this tool effective in detecting the coelution. The problem was also easily resolved by adjusting the methanol content in the mobile phase.

(R)-2-chloromandelic acid

The HPLC analysis of chloromandelic acid and chloromandelonitrile offered many of the challenges associated with the analysis of the phenylglycine samples. From the chromatogram shown in FIG. 7A, which contains only chloromandelonitrile in buffer, it is evident that a peak eluted at the same time as the product in the chromatogram shown in FIG. 7B, which represents a chloromandelic acid standard. The contribution of the cell lysate to this peak was found to be small; it would appear that the greatest contribution to this peak was from the chloromandelonitrile, either from a breakdown product or a contaminant in the nitrile preparation. The peak area remained constant throughout each experiment and, using the appropriate controls, it was found that subtraction of the peak area from that of the product yielded sufficient accuracy. Many attempts were made to change the HPLC conditions so that the product peak eluted at a later time; however, these attempts were not successful. Chromatogram shown in FIG. 7C illustrates the appearance of product and the reduction of the substrate peaks.

The chiral analysis of chloromandelic acid was almost problem-free. The elution of a small peak at the same time as the (S)-enantiomer presented some concern (the peak at 2.4 min in chromatogram shown in FIG. 7D). However, once it was established that this peak was present in all the samples at the same level, including the blank control, and that it had a different UV spectrum to that of the chloromandelic acid peak, it was not regarded as a problem. Consequently, it was subtracted from the peak eluting at 2.4 min in each sample. The (R)-enantiomer eluted at 3 minutes.

(S)-phenyllacetic acid

The analysis of phenyllacetic acid was initially plagued with the same problems discussed for phenylglycine and 2-chloromandelic acid. However, in this case, adjustment of the solvent concentration in the nonchiral HPLC method led to a shift in the retention time of the acid, so that it no longer coeluted with the cell lysate peak. Following this, no problems were encountered with either the nonchiral or chiral methods. Representative nonchiral chromatograms of the product (1.9 min) and cyanohydrin substrate (3.7 min) are shown in FIG. 8A, while the chiral analysis of the acid is shown in FIG. 8B, with the L-enantiomer eluting at 2 min and the opposite enantiomer at 6 min.

L-2-methylphenylglycine

The analysis of methylphenylglycine was unproblematic, although the nonchiral method did not provide baseline separation between a cell lysate peak and the product peak, as shown in the chromatogram illustrated in FIG. 9A. The amino acid standard for this method was provided in the final stages of the project, thus minimizing the time for method development. In the chromatogram shown in FIG. 9A the amino acid elutes at 0.7 min and the aminonitrile at 5.0 min. Sufficient separation between the two initial peaks was obtained to allow the calculation of approximate conversion to product.

Figure 9B:
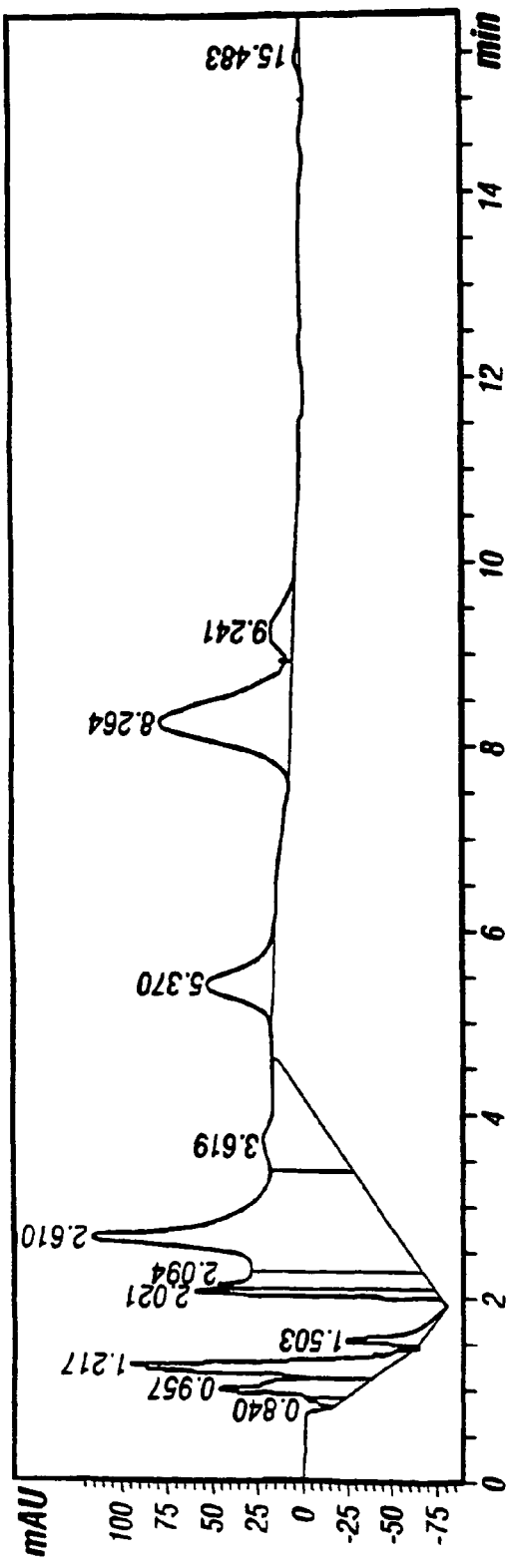

The chiral analysis of this compound provided good separation between the two enantiomers, as shown in the chromatogram illustrated in FIG. 9B. The L-enantiomer elutes at 5 min and the D-enantiomer at 8 min.

L-tert-leucine

Figure 10A:
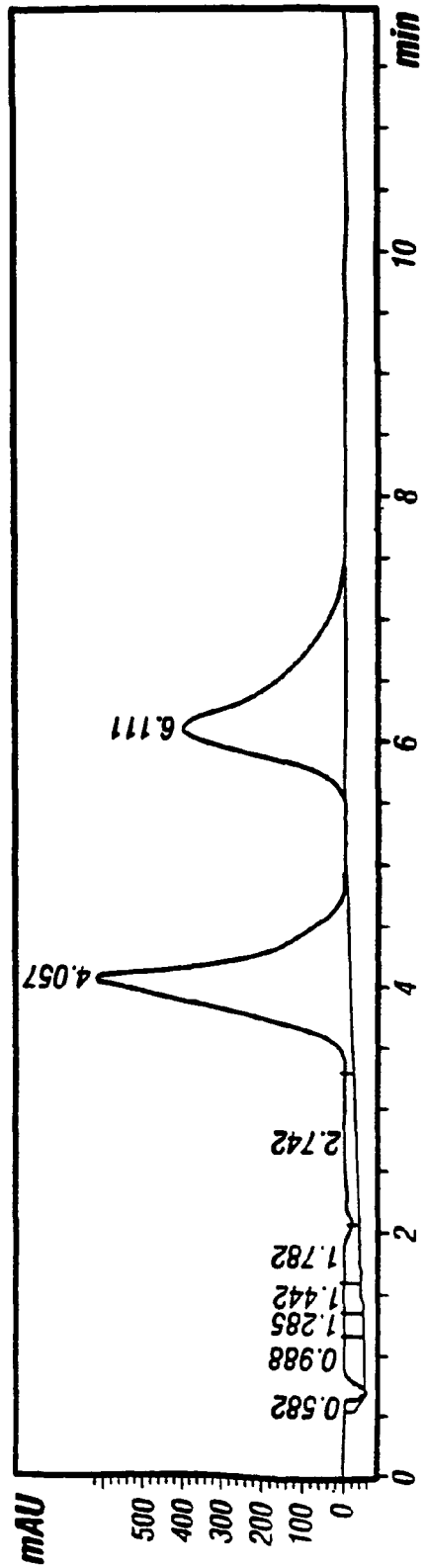

For the nonchiral analysis of t-leucine, the cell lysate presented the most serious problem amongst the group of products for this project. This was compounded by the low spectroscopic properties of the amino acid, leading to difficulty in differentiating the product peak from the cell lysate. Good separation of the individual product enantiomers was obtained by chiral analysis as shown in FIG. 10A. During the primary screen, a small peak eluted at the same time as the L-amino acid standard in certain samples (see FIG. 10B) and was thought to be the amino acid. However, further development of the method and the use of the appropriate controls established that this peak was actually a cell lysate peak.

The aminonitrile eluted between the two t-leucine peaks, as shown in FIG. 10C; this chromatogram also shows the cell lysate peak at 4.8 min. The UV spectrum of the nitrile was distinct from that of the amino acid, making it easier to differentiate from the acid peaks.

L-hydroxynorleucine ((S)-2-amino-6-hydroxy hexanoic acid)

The chiral analysis of (S)-2-amino-6-hydroxy hexanoic acid was consistent and reliable. By contrast, the nonchiral method presented many problems, primarily as a result of non-separation between the nitrile and the acid peaks. Towards the latter half of the project, a method was developed and used successfully for the confirmation of activities. Prior to this, most of the analysis was performed using the chiral method; standard curves of the products were run in order to quantify the reactions. A representative chromatogram of (S)-2-amino-6-hydroxy hexanoic acid is shown in FIG. 11A, with (S)-2-amino-6-hydroxy hexanoic acid eluting at 6 min. The aminonitrile was not detected by this method.

Separation of the individual 2-amino-6-hydroxy hexanoic acid enantiomers is shown in FIG. 11B. The L-enantiomer elutes first, at 2 min, followed by the D-enantiomer at 3 min. In FIG. 11C, an enzymatic sample is represented; the only area of slight concern is the negative peak preceding the elution of the L-enantiomer. However, it did not appear to interfere significantly with the elution of this enantiomer; method development did not eliminate the negative peak.

4-methyl-D-leucine and 4-methyl-L-leucine

Figure 12B:
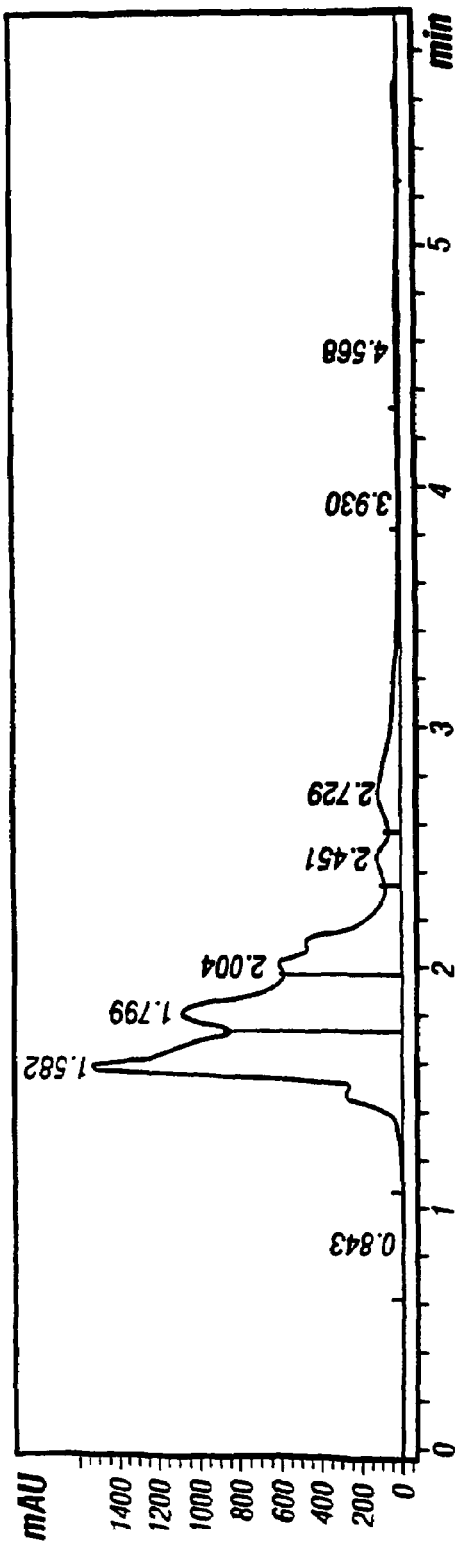
Figure 12C:
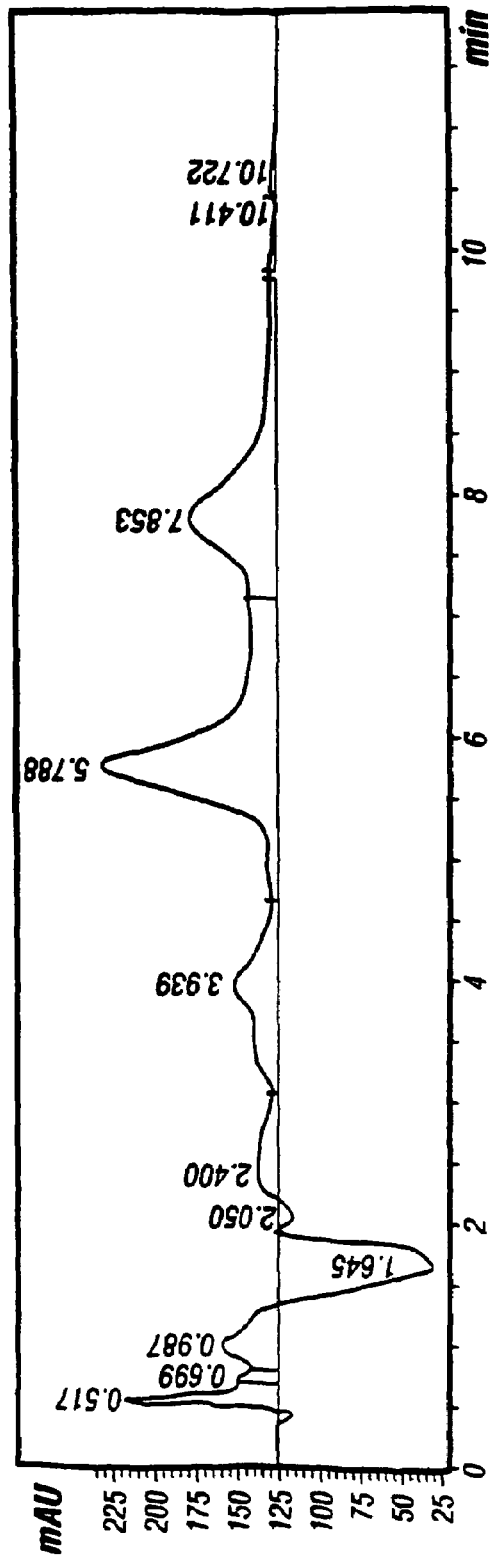
Figure 12D:
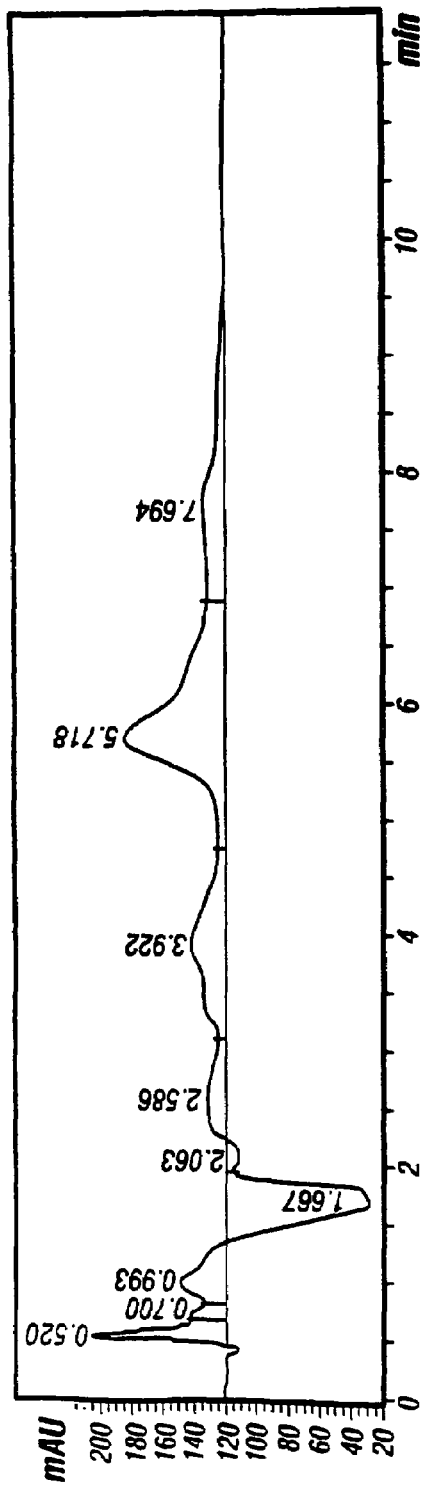

For the detection of 4-methylleucine, the chiral HPLC method again proved more reliable. The combination of low activities, together with the low sensitivity of the method to the compound led to difficulties in detection using nonchiral HPLC. A 2.5 mM standard of the amino acid is shown in FIG. 12A, with a peak height of approximately 40 mAU; this was substantially lower than those detected for the aromatic compounds. Chromatogram in FIG. 12B shows an enzymatic sample, in which conversion was detected using the chiral HPLC method; while it is not clear, it would appear that the 4-methylleucine peak elutes at 2.7 min and is extremely low in both peak height and area. This peak did not appear in samples which were negative by chiral HPLC analysis.

The chiral analysis of 4-methyl-L-leucine and 4-methyl-D-leucine did not present any problems. The L-enantiomer eluted at 5 min and the D-enantiomer at 7 min, although some peak shift did occur, as a result of the sensitivity to the column, described in section (i) for phenylglycine. In chromatograms shown in FIGS. 14C-14D, the separation of these amino acids is shown; the first sample represents an enzyme which produced both enantiomers and in the second sample, the enzyme preferentially hydrolyzed the L-enantiomer, with a small amount D-amino acid forming.

(S)-cyclohexylmandelic acid

Figure 13A:
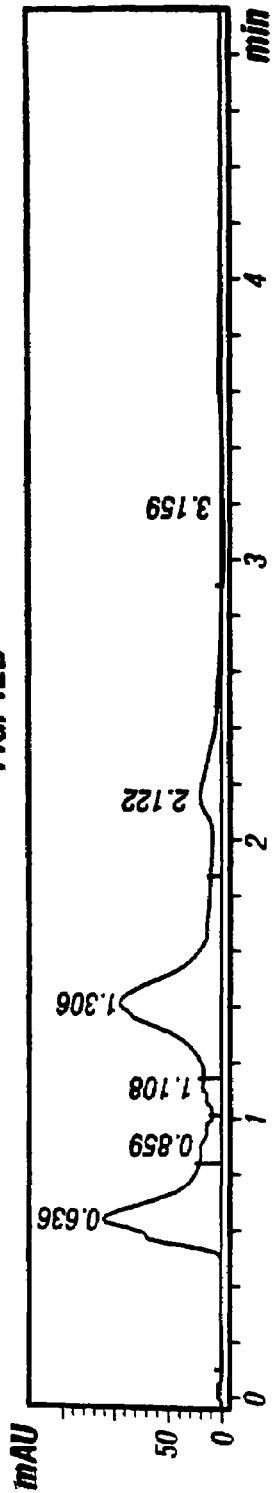
FIGS. 13A-13B illustrate chromatograms characteristic of substrate and product combinations for (S)-cyclohexylmandelic acid.
Figure 13B:
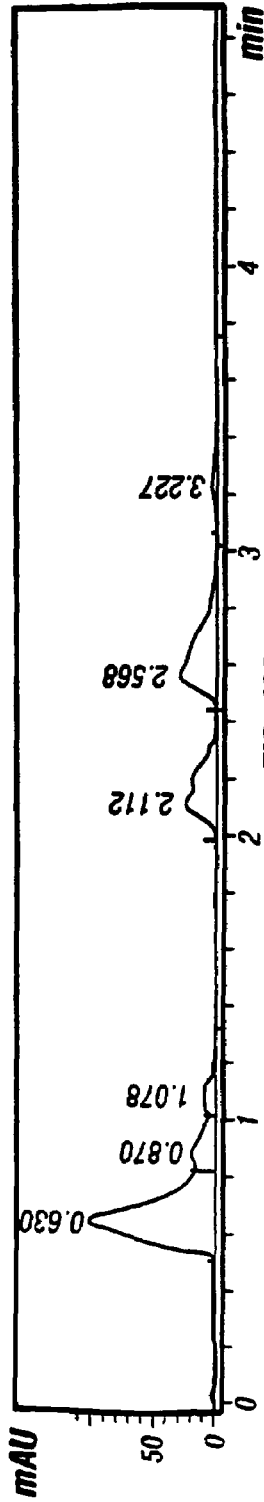

Chromatograms of the standards for cyclohexylmandelic acid (FIG. 13A) and the corresponding nitrile (FIG. 13B) are shown. The acid eluted at 1.3 min, while the cyanohydrin was observed at 2.5 mm. The peak eluting at 2.1 min is thought to be the cyclohexylphenylketone, as shown by the elution of a ketone standard at this point.

Example 12

An Enzyme Library Approach to Biocatalysis: Development of a Nitrilase Platform for Enantioselective Production of Carboxylic Acid Derivatives Biocatalytic processes can offer unique advantages in transformations that are challenging to accomplish through conventional chemical methods (Wong, C.-H.; Whitesides, G. M. Enzymes in Synthetic Organic Chemistry, Pergamon, N.Y., 1994; Drauz, K.; Waldmann, H., Roberts, S. M. Eds. Enzyme Catalysis in Organic Synthesis; VCH: Weinheim, Germany, 2nd ed., 2002). Nitrilases (EC 3.5.5.1) promote the mild hydrolytic conversion of organonitriles directly to the corresponding carboxylic acids (Kobayashi, M.; Shimizu, S. FEMS Microbiol. Lett. 1994, 120, 217; Bunch, A. W. In Biotechnology; Rehm, H.-J.; Reed, G.; Puhler, A.; Stadler, P., Eds.; Wiley-VCH: Weinheim, Germany, Vol. 8a, Chapter 6, pp 277-324; Wieser, M.; Nagasawa, T. In Stereoselective Biocatalysis; Patel, R. N., Ed.; Marcel Dekker: New York, 2000, Chapter 17, pp 461-486.) Fewer than fifteen microbially-derived nitrilases have been characterized and reported to date. (Harper, D. B. Int. J. Biochem. 1985, 17, 677; Levy-Schil, S.; Soubrier, F.; Crutz-Le Coq, A. M.; Faucher, D.; Crouzet, J.; Petre, D. Gene 1995, 161, 15; Yu, F. 1999, U.S. Pat. No. 5,872,000; Ress-Loschke, M.; Friedrich, T.; Hauer, B.; Mattes, R.; Engels, D. PCT Appl. WO 00/23577, April 2000.). Several nitrilases previously have been explored for the preparation of single-enantiomer carboxylic acids, although little progress has been made in the development of nitrilases as viable synthetic tools. This application describes the discovery of a large and diverse set of ZS nitrilases and herein demonstrate the utility of this nitrilase library for identifying enzymes that catalyze efficient enantioselective production of valuable hydroxy carboxylic acid derivatives.

In an effort to access the most diversified range of enzymes that can be found in Nature, we create large genomic libraries by extracting DNA directly from environmental samples that have been collected from varying global habitats. (For a description of these methods, see: Short, J. M. Nature Biotech. 1997, 15, 1322; Handelsman, J.; Rondon, M. J.; Brady, S. F.; Clardy, J.; Goodman, R. M. Chem. Biol. 1998, 5, R245; Henne, A.; Daniel, R.; Schmitz, R. A.; Gottschalk, G. Appl. Environ. Microbiol. 1999, 65, 3901). We have established a variety of methods for identifying novel activities through screening mixed populations of uncultured DNA. (Robertson, D. E.; Mathur, E. J.; Swanson, R. V.; Marrs, B. L.; Short, J. M. SIM News 1996, 46, 3; Short, J. M. U.S. Pat. No. 5,958,672, 1999; Short J. M. U.S. Pat. No. 6,030,779,2000.) Through this approach, nearly 200 new nitrilases have been discovered and characterized. (For a concise description of the studies, see Materials and Methods section below.) All nitrilases were defined as unique at the sequence level and were shown to possess the conserved catalytic triad Glu-Lys-Cys which is characteristic for this enzyme class. (Pace, H.; Brenner, C. Genome Biology 2001, 2, 0001.1-0001.9.) Each nitrilase in our library was overexpressed and stored as a lyophilized cell lysate in order to facilitate rapid evaluation of the library for particular biocatalytic functions.

The initial investigations focused upon the efficacy of nitrilases for production of α-hydroxy acids 2 formed through hydrolysis of cyanohydrins 1. Cyanohydrins are well-documented to racemize readily under basic conditions through reversible loss of HCN. (Inagaki, M.; Hiratake, J.; Nishioka, T.; Oda, J.; J. Org. Chem 1992, 57, 5643. (b) van Eikeren, P. U.S. Pat. No. 5,241,087, 1993.) Thus, a dynamic kinetic resolution process is possible whereby an enzyme selectively hydrolyzes only one enantiomer of 1, affording 2 in 100% theoretical yield and with high levels of enantiomeric purity.

One important application of this type involves commercial production of (R)-mandelic acid from mandelonitrile. (Ress-Loschke, M.; Friedrich, T.; Hauer, B.; Mattes, R.; Engels, D. PCT Appl. WO 00/23577, April 2000; Yamamoto, K.; Oishi, K.; Fujimatsu, I.; Komatsu, K. *Appl. Environ. Microbiol.* 1991, 57, 3028; Endo, T.; Tamura, K. U.S. Pat. No. 5,296,373, March 1994.) Mandelic acid and derivatives find broad use as intermediates and resolving agents for production of many pharmaceutical and agricultural products. (Coppola, G. M.; Schuster, H. F. Chiral α-Hydroxy Acids in Enantioselective Synthesis; Wiley-VCH: Weinheim, Germany: 1997.) However, the few known nitrilases derived from cultured organisms have not been found useful for efficient and selective hydrolysis of analogous substrates.

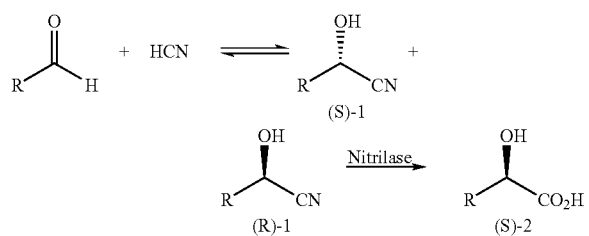

The nitrilase library was screened for activity and enantioselectivity in the hydrolysis of mandelonitrile (3a, Ar=phenyl) to mandelic acid. Preliminary results revealed

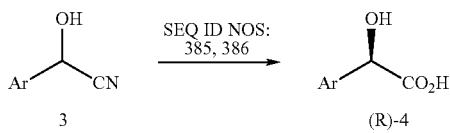

that 27 enzymes afforded mandelic acid in >90% ee. One enzyme, SEQ ID NOS:385, 386, was studied in greater detail and was found to be very active for hydrolysis of mandelonitrile. Under standard conditions using 25 mM 3a and 0.12 mg/mL enzyme in 10% MeOH (v/v) 0.1 M phosphate buffer at 37° C. and pH 8, (R)-mandelic acid was formed quantitatively within 10 min and with 98% ee. To confirm synthetic utility, the reaction was performed using 1.0 g 3a (50 mM) and 9 mg nitrilase (0.06 mg/mL nitrilase I); after 3 h (R)-mandelic acid was isolated in high yield (0.93 g, 86%) and again with 98% ee.

(a) Reactions were conducted under standard conditions (see text). Reaction time for complete conversion to 4 was 1-3 h. Entries 8-9 were conducted at pH 9 and 5 mM substrate concentration. (b) Specific activities were measured at 5 min transformation timepoints and are expressed as μmol mg$^{-1}$ min$^{-1}$. (c) TOF=turnover frequency, mol product/mol catalyst/sec. (d) Enantioselectivites were determined by chiral HPLC analysis. Hydroxy acids were isolated and absolute configurations were determined to be (R) in all cases.

The substrate scope of SEQ ID NOS:385, 386 was next explored. As shown in Table 13, a broad range of mandelic acid derivatives as well as aromatic and heteroaromatic analogues (4) may be prepared through this method. SEQ ID NOS:385, 386 tolerates aromatic ring substituents in the ortho-, meta-, and para-positions of mandelonitrile derivatives and products of type 4 were produced with high enantioselectivities. Other larger aromatic groups such as 1-naphthyl and 2-naphthyl also are accommodated within the active site, again affording the acids 4 with high selectivity (Table 13, entries 8-9). Finally, 3-pyridyl and 3-thienyl analogues of mandelic acid were prepared readily using this process (Table 13, entries 10-11). This is the first reported demonstration of a nitrilase that affords a range of mandelic acid derivatives and heteroaromatic analogues of type 4. High activity on the more sterically encumbered ortho-substituted and 1-naphthyl derivatives is particularly noteworthy.

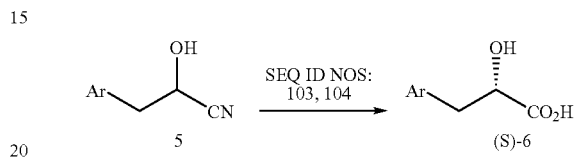

We next examined the preparation of aryllactic acid derivatives 6 through hydrolysis of the corresponding cyanohydrins 5. Phenyllactic acid and derivatives serve as versatile building blocks for the preparation of numerous biologically active compounds. (Coppola, G. M.; Schuster, H. F. Chiral α-Hydroxy Acids in Enantioselective Synthesis; Wiley-VCH: Weinheim, Germany: 1997.) Upon screening our nitrilase library against the parent cyanohydrin 5a (Ar=phenyl), we found several enzymes that provided 6a with high enantiomeric excess. One enzyme, SEQ ID NOS: 103, 104, was further characterized. After optimization, SEQ ID NOS:103, 104, was shown to provide (S)-phenyllactic acid (6a) with complete conversion (50 mM) and very high enantioselectivity (98% ee) over 6 h. The highest enantioselectivity previously reported for biocatalytic conversion of 5 to 6 was 75% ee achieved through a whole cell transformation using a *Pseudomonas* strain. (Hashimoto, Y.; Kobayashi, E.; Endo, T.; Nishiyama, M.; Horinouchi, S. *Biosci. Biotech. Biochem.* 1996, 60, 1279.)

TABLE 7

Nitrilase II-catalyzed production of aryllactic acid derivatives and analogues 6[a]

| Entry | Ar in 6 | Spec. Act.[b] | TOF[c] | % ee[d] |
|---|---|---|---|---|
| 1 | C$_6$H$_5$ | 25 | 16 | 99 |
| 2 | 2-Me—C$_6$H$_5$ | 160 | 100 | 95 |
| 3 | 2-Br—C$_6$H$_5$ | 121 | 76 | 95 |
| 4 | 2-F—C$_6$H$_5$ | 155 | 97 | 91 |
| 5 | 3-Me—C$_6$H$_5$ | 21 | 13 | 95 |
| 6 | 3-F—C$_6$H$_5$ | 22 | 14 | 99 |
| 7 | 1-naphthyl | 64 | 40 | 96 |
| 8 | 2-pyridyl | 10.5 | 6.6 | 99 |
| 9 | 3-pyridyl | 11.6 | 7.2 | 97 |
| 10 | 2-thienyl | 3.4 | 2.1 | 96 |
| 11 | 3-thienyl | 2.3 | 1.4 | 97 |

[a]Reaction conditions as in Table 13, except 0.016 mg/mL nitrilase was used. Full conversion to 6 was observed within 6 h.
[b-d]See Table 13. The absolute configuration was determined to be (S) for phenyllactic acid and entries 2-11 were assigned (S) based upon identical chiral HPLC peak elution order.

(a) Reaction conditions as in Table 13, except 0.016 mg/mL nitrilase was used. Full conversion to 6 was observed within 6 h. (b)-(d) See Table 13. The absolute configuration was determined to be (S) for phenyllacetic acid and entries 2-11 were assigned (S) based upon identical chiral HPLC peak elution order.

Ortho and meta substituents appear to be tolerated well by nitrilase II, with ortho substituted derivatives surprisingly being converted with higher rates relative to the parent substrate 5a. Novel heteroaromatic derivatives, such as 2-pyridyl-, 3-pyridyl, 2-thienyl- and 3-thienyllactic acids, were prepared with high conversions and enantioselectivities (entries 8-11). Unexpectedly, para substituents greatly lowered the rates of these reactions, with full conversion taking over two weeks under these conditions.

The final transformation that we examined was desymmetrization of the readily available prochiral substrate 3-hydroxyglutarylnitrile (7) (Johnson, F.; Panella, J. P.; Carlson, A. A. *J. Org. Chem.* 1962, 27, 2241) to afford hydroxy acid (R)-8 which, once esterified to (R)-9, is an intermediate used in the manufacture of the cholesterol-lowering drug LIPITOR™. Previously reported attempts to use enzymes for this process were unsuccessful and 8 was produced with low selectivity (highest: 22% ee) and the undesired (S)-configuration. (Crosby, J. A.; Parratt, J. S.; Turner, N. J. *Tetrahedron: Asymmetry* 1992, 3, 1547; Beard, T.; Cohen, M. A.; Parratt, J. S.; Turner, N. J. *Tetrahedron: Asymmetry* 1993, 4, 1085; Kakeya, H.; Sakai, N.; Sano, A.; Yokoyama, M.; Sugai, T.; Ohta, H. *Chem. Lett.* 1991, 1823.)

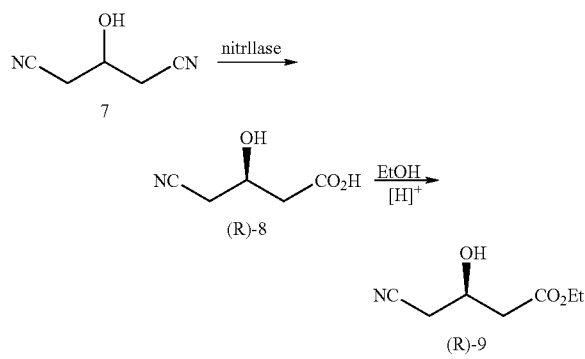

The nitrilase library was screened and unique enzymes were discovered and isolated that provided the required product (R)-8 with high conversion (>95%) and >90% ee. Using one of the (R)-specific nitrilases, this process was operated on a 1.0 g scale (240 mM 7, 30 mg enzyme, 22° C., pH 7) and after 22 h, (R)-8 was isolated in 98% yield and 95% ee. Interestingly, the same screening program also identified nitrilases that afford the opposite enantiomer (S)-8 with 90-98% ee. Thus, the extensive screen of biodiversity has uncovered enzymes that provide ready access to either enantiomer of the intermediate 8 with high enantioselectivities. Our discovery of the first enzymes that furnish (R)-8 underscores the advantage of having access to a large and diverse library of nitrilases.

By plumbing our environmental genomic libraries created from uncultured DNA, we have discovered a large array of novel nitrilases. This study has revealed specific nitrilases that furnish mandelic and aryllactic acid derivatives, as well as either enantiomer of 4-cyano-3-hydroxybutyric acid in high yield and enantiomeric excess.

Procedures and Analytical Data:

Hydroxyglutarylnitrile was purchased from TCI America and used as received. Amino acids used for the preparation of aryl lactic acid standards were purchased from PepTech (Cambridge, Mass.). (R)-3-hydroxy-4-cyanobutyric acid was obtained from Gateway Chemical Technology (St. Louis, Mo.). Both (R)- and (S)-mandelic acid and (R)- and (S)-phenyl lactic acid standards were purchased from Sigma Aldrich. All other reagents were purchased from Sigma Aldrich and utilized without further purification. Silica Gel, 70-230 mesh, 60 Å, purchased from Aldrich, was used for chromatographic purifications. All $^1$H NMRs and $^{13}$C NMRs were run on Bruker model AM-500 machines, set at room temperature, 500 MHz and 125 MHz respectively for $^1$H and $^{13}$C. Mass analyses and unit mass resolution was achieved by flow injection analysis (FIA) using a Perkin-Elmer Sciex API-4000 TURBOION™ Spray LC/MS/MS system. The LC flow was provided by Schimadzu LC-10Advp pumps, with 0.05% acetic acid and MeOH. Injections were accomplished via a Valco injector valve. The HPLC analysis was done on an Agilent 1100 HPLC with Astec's Chirobiotic R column (100×4.6 mm, cat no. 13022 or 150×4.6 mm, cat no. 13023) or Daicel's Chiralcel OD column (50×4.6 mm, cat no. 14022) and the DAD detector set at 210, 220, 230, and 250 nm. For specific rotations, a Perkin Elmer Model 341 Polarimeter was used, set at 589 nm, Na lamp, at room temperature, with a 100 mm path length cell. Concentrations for specific rotation are reported in grams per 100 mL of solvent. Microbiology techniques were executed in accordance to published protocols. (Sambrook, J. Fritsch, E F, Maniatis, T. (1989) Molecular Cloning: A Laboratory Manual (2nd ed.), Cold Spring Harbor Laboratory Press, Plainview N.Y.) Glycolic acid products were isolated and absolute configurations were determined to be (R) in all cases by comparison with literature optical rotation data on configurationally defined compounds except for (−)-3-pyridylglycolic acid, which to our knowledge is not known as a single enantiomer. (For mandelic, 2-chloromandelic, 2-methyl mandelic, 3-chloromandelic, 3-bromomandelic and 4-fluoromandelic acid see Hoover, J. R. E.; Dunn, G. L.; Jakas, D. R.; Lam, L. L.; Taggart, J. J.; Guarini, J. R.; Phillips, L. *J. Med. Chem.* 1974, 17(1), 34-41; For 2-bromo mandelic acid see Collet, A.; Jacques, J.; *Bull. Soc. Chem. Fr.* 1973, 12, 3330-3331; For 1- and 2-napthylglycolic acid see Takahashi, I; Y. Aoyagi, I. Nakamura, Kitagawa, A., Matsumoto, K., Kitajima, H. Isa, K. Odashima, K. Koga, K. *Heterocycles* 1999, 51(6), 1371-88; For 3-thienylglycolic acid Gronowitz, S. *Ark Kemi,* 1957, 11, 519-525.)

For the aryl lactic acid products, absolute configuration was established to be (S) for phenyl lactic acid by comparison with literature optical rotation and for all other phenyl lactic acid products, absolute configurations were predicted based upon elution order using chiral HPLC. Absolute configuration for 3-hydroxy-4-cyano-butanoic acid was established by derivatization to (R)-(−)-Methyl (3-O-[benzoyl]-4-cyano)-butanoate and comparison to literature optical rotation data on configurationally defined compound. (3. Beard, T. Cohen, M. A. Parratt, J. S. Turner, N. J. *Tetrahedron:Asymm.* 4(6), 1993, 1085-1104.)

Nitrilase Discovery and Characterization Methods:

1. Nitrilase Selection.

An *Escherichia coli* screening host strain, SEL700, was optimized for nitrilase selections on a nitrile substrate. An $Abs_{600nm}=1$, resuspension of SEL700 screening host in 10 mM $MgSO_4$ was infected with kanamycin-resistant environmental DNA library for 45 minutes at 37° C., such that complete screening coverage of the library was achieved. Infected cells, now denoted by kanamycin resistance, were plated on kanamycin LB plates and allowed to grow overnight at 30° C. Titer plates were also made to determine infection efficiency.

Cells were pooled, washed, and resuspended the next morning with 10 mM MgSO$_4$. Transformed clones were inoculated into M9 media (without nitrogen) with 10 mM of nitrile substrate. M9 media consisted of 1×M9 salts (NH$_4$Cl omitted), 0.1 mM CaCl$_2$, 1 mM MgSO$_4$, 0.2% glucose, and approximately 10 µM of a nitrile selection substrate. The selection cultures were then incubated at 30° C., shaking at 200 rpm, for up to five weeks. Positive nitrilase cultures were identified by growth, due to positive clone's ability to hydrolyze nitrile substrate. Positive clones were isolated by streaking out a selection culture with growth and subsequent secondary culturing of isolated colonies in the same defined media. The DNA from any positive secondary cultures exhibiting re-growth was then isolated and sequenced to confirm discovery of a nitrilase gene and to establish the unique nature of that gene.

2. Nitrilase Biopanning.

Traditional filter lift hybridization screening protocols are limited to libraries with approximately 10$^6$ to 10$^7$ members. Attempting to screen one library would require approximately 5,000 filter lifts. Therefore, solution phase and other biopanning formats have been developed for ultra high throughput sequence based screening permitting rapid screening of up to 10$^8$ member environmental libraries In the solution format, the DNA from a large number of library clones is mixed with tagged molecules of interest under conditions which promote hybridization. The tagged clones and hybridized DNA are then removed from solution and washed at some level of stringency to remove clones which do not have sequence identity with the probe. The hybridized DNA is then eluted and recovered. Clones of interest are sequenced and cloned to provide enzyme activities of interest. This method has been demonstrated to achieve up to 1,000-fold enrichment per round for sequences of interest.

3. High Throughput Nitrilase Activity Assay.

Activity assays were conducted using 25 mM (~3 mg/mL) substrate, 0.1 mg/mL nitrilase in 0.25 mL of assay solution. Assay solutions consisted of 0-10% (v/v) MeOH in 0.1 M sodium phosphate buffer solution at pH 7 to 9 and temperatures 37° C. or 22° C. Specific activities were measured at 5 min transformation time point, unless otherwise noted, and are expressed in units µmol mg$^{-1}$ min$^{-1}$. Enantiomeric excess and conversion rates were determined by high throughput HPLC analysis comparing enzyme product concentration to standard curves of racemic acid products. Analytical conditions for the products are tabulated below.

Analytical Methods:

| | Acid Product | Column | Liquid Chromatography Method | Retention Times of enantiomers (min) |
|---|---|---|---|---|
| 1.1 | mandelic acid | Chirabiotic R 100 × 4.6 mm | 20%[0.5% AcOH], 80% CH$_3$CN 1 ml/min | 2.4 (S); 2.9 (R) |
| 1.2 | 2-Cl-mandelic acid | Chirabiotic R 100 × 4.6 mm | 20%[0.5% AcOH], 80% CH$_3$CN 1 ml/min | 2.3 (S); 2.9 (R) |
| 1.3 | 2-Br-mandelic acid | Chirabiotic R 100 × 4.6 mm | 20%[0.5% AcOH], 80% CH$_3$CN 1 ml/min | 2.8; 4.0 |
| 1.4 | 2-CH$_3$-mandelic acid | Chirabiotic R 100 × 4.6 mm | 20%[0.5% AcOH], 80% CH$_3$CN 1 ml/min | 3.1; 3.8 |
| 1.5 | 3-Cl-mandelic | Chirabiotic R 100 × 4.6 mm | 10%[0.5% AcOH], 90% CH$_3$CN 1 ml/min | 3.1; 3.8 |
| 1.6 | 3-Br-mandelic | Chirabiotic R 100 × 4.6 mm | 10%[0.5% AcOH], 90% CH$_3$CN 1 ml/min | 3.3; 3.9 |
| 1.7 | 4-F-mandelic | Chirabiotic R 150 × 4.6 mm | 20%[0.5% AcOH], 80% CH$_3$CN 1 ml/min | 3.7; 4.8 |
| 1.8 | 1-napthylglycolic acid | Chirabiotic R 100 × 4.6 mm | 4%[0.5% AcOH], 96% CH$_3$CN 1 ml/min | 3.1; 3.7 |
| 1.9 | 2-napthylglycolic acid | Chirabiotic R 100 × 4.6 mm | 4%[0.5% AcOH], 96% CH$_3$CN 1 ml/min | 3.7; 4.7 |
| 1.10 | 3-pyridylglycolic acid | Chirabiotic R 100 × 4.6 mm | 5% [0.5% AcOH], 65% H$_2$O, 30% CH$_3$CN, 2 ml/min | 4.4; 5.5 |
| 1.11 | 3-thienylglycolic acid | Chirabiotic R 100 × 4.6 mm | 20%[0.5% AcOH], 80% CH$_3$CN 2 ml/min | 1.4; 2.5 |
| 2.1 | phenyl lactic acid | Chirabiotic R 150 × 4.6 mm | 20%[0.5% AcOH], 80% CH$_3$CN 1 ml/min | 2.8 (S); 4.0 (R) |
| 2.2 | 2-methylphenyl lactic acid | Chirabiotic R 150 × 4.6 mm | 20%[0.5% AcOH], 80% CH$_3$CN 1 ml/min | 2.5; 2.8 |
| 2.3 | 2-bromophenyl lactic acid | Chirabiotic R 150 × 4.6 mm | 20%[0.5% AcOH], 80% CH$_3$CN 1 ml/min | 2.8; 3.2 |
| 2.4 | 2-fluorophenyl lactic acid | Chirabiotic R 150 × 4.6 mm | 20%[0.5% AcOH], 80% CH$_3$CN 1 ml/min | 2.6; 2.9 |
| 2.5 | 3-methylphenyl lactic acid | Chirabiotic R 150 × 4.6 mm | 20%[0.5% AcOH], 80% CH$_3$CN 1 ml/min | 2.4; 3.2 |
| 2.6 | 3-fluorophenyl lactic acid | Chirabiotic R 150 × 4.6 mm | 20%[0.5% AcOB], 80% CH$_3$CN 1 ml/min | 2.8; 3.6 |
| 2.7 | 1-napthyllactic acid | Chirabiotic R 150 × 4.6 mm | 20%[0.5% AcOH], 80% CH$_3$CN 1 ml/min | 2.7; 3.1 |
| 2.8 | 2-pyridyllactic acid | Chirabiotic R 150 × 4.6 mm | 20%[0.5% AcOH], 80% CH$_3$CN 1 ml/min | 2.5; 2.9 |
| 2.9 | 3-pyridyllactic acid | Chirabiotic R 150 × 4.6 mm | 20%[0.5% AcOH], 80% CH$_3$CN 1 ml/min | 2.9; 3.6 |
| 2.10 | 2-thienyllactic acid | Chirabiotic R 150 × 4.6 mm | 20%[0.5% AcOH], 80% CH$_3$CN 1 ml/min | 3.6; 4.6 |
| 2.11 | 3-thienyllactic acid | Chirabiotic R 150 × 4.6 mm | 20%[0.5% AcOH], 80% CH$_3$CN 1 ml/min | 3.5; 4.6 |

-continued

Analytical Methods:

| Acid Product | Column | Liquid Chromatography Method | Retention Times of enantiomers (min) |
|---|---|---|---|
| Methyl(3-O [benzoyl]-4-cyano)-butanoate | Daicel OD 50 × 4.6 mm | 5% isopropanol, 95% hexane 1 ml/min | 4.5 (R); 5.4 (S) |

Cyanohydrin (Substrate) Synthesis:

Mandelonitrile Synthesis Method A: Acetone cyanohydrin (685 μL, 7.5 mmol), aldehyde (5 mmol), and catalytic DIEA (13 μL, 0.075 mmol) were mixed at 0° C. The reactions were stirred on ice for 45 minutes. To drive the equilibrium toward the product, acetone was removed in vacuo. Subsequently, crude reactions were acidified with $H_2SO_4$ (3 μL) and stored at −20° C. TLC was used to monitor reaction progress (3:1 hexane/ethylacetate (EtOAc).

Mandelonitrile Synthesis Method B: To a solution of KCN (358 mg, 5.5 mmol) in MeOH (1 mL) at 0° C. was added aldehyde (5 mmol) and acetic acid (315 μL, 5.5 mmol). After stirring for one hour on ice, MeOH was removed in vacuo, and the crude mixture was partitioned using EtOAc and $H_2O$. The organic fraction was retained and concentrated in vacuo. TLC analysis was used to monitor reaction progress (3:1 Hexanes/EtOAc).

Aryl Acetaldehyde Cyanohydrin: Arylacetic acid (50 mmol) was dissolved in 50 ml anhydrous tetrahydrofuran (THF) in a two-neck 500 ml round-bottom flask under $N_2(g)$ atmosphere. To this solution cooled to 0° C., under vigorous mixing, was added slowly 105 mmol of thexylchloroborane-dimethyl sulfide (2.55 M in methylene chloride). The reaction was allowed to proceed overnight. Excess acetic acid (10 ml) was added to quench and acidify the reaction followed by the addition 10 ml water. After stirring at room temperature for 1 hour, solvent was removed in vacuo and the residue was dissolved in 100 ml water and extracted with 200 ml EtOAc. The EtOAc layer was dried over sodium sulfate, filtered and then concentrated in vacuo. Subsequently, 60 mmol of KCN, followed by 100 ml methanol was added to the residue. The solution was then cooled to 0° C. and acetic acid (60 mmol) added. The reaction was stirred for 1-2 hours after all KCN dissolved. Solvents were removed in vacuo and residue was dissolved in 100 ml water and 200 ml EtOAc. The aqueous layer was extracted with EtOAc one more time. Combined EtOAc extracts were washed with saturated brine and dried over sodium sulfate, filtered and then concentrated in vacuo to obtain crude cyanohydrin product. The cyanohydrin was purified by silica-gel column (hexane/EtOAc), as necessary.

2-chloro mandelonitrile: $^1$H NMR (CDCl$_3$, 500 MHz) δ 7.69 (m, 1H), 7.41 (m, 1H), 7.36 (m, 2H), 5.84 (s, 1H), 3.07 (br, 1H). $^{13}$C NMR (CDCl$_3$, 125 MHz) δ 132.89, 132.73, 131.22, 130.19, 128.48, 127.84, 118.24, 60.87. MS calc'd for [C$_8$H$_6$ClNO] 167.01 found 167.9 (LC-MS+).

2-bromomandelonitrile: $^1$H NMR (CDCl$_3$, 500 MHz) δ 7.72 (d, 1H, J=6.58), 7.62 (d, 1H, J=8.35), 7.43 (t, 1H, J=8.42), 7.30 (t, 1H, J=7.00), 5.85 (s, 1H). $^{13}$C NMR (CDCl$_3$, 125 MHz) δ 134.550, 133.584, 131.564, 128.819, 128.535, 122.565, 118.153, 63.379.

2-methylmandelonitrile: $^1$H NMR (CDCl$_3$, 500 MHz) δ: 7.60 (d, 1H, J=7.4), 7.23-7.35 (m, 3H), 5.66 (s, 1H), 2.44 (s, 3H). $^{13}$C NMR (CDCl$_3$, 298 K, 125 MHz) δ: 136.425, 133.415, 131.450, 130.147, 127.204, 126.894, 118.952, 18.916. MS calc'd for [C$_9$H$_9$NO] 147.07, found 147.2 (ESI+).

3-chloromandelonitrile: $^1$H NMR (CDCl$_3$, 500 MHz) δ 7.55 (s, 1H), 7.43-7.37 (m, 3H), 5.54 (s, 1H). $^{13}$C NMR (CDCl$_3$, 125 MHz) δ 137.183, 135.480, 130.718, 130.303, 127.047, 124.891, 118.395, 63.156. MS calc'd for [C$_9$H$_6$ClNO] 167.01 found 167.9 (LC-MS+).

3-bromomandelonitrile: $^1$H NMR (CDCl$_3$, 500 MHz) δ 7.69 (s, 1H), 7.56 (d, J=6.2 Hz, 1H), 7.45 (d, J=5.5 Hz, 1H), 7.32 (t, J=6.4. Hz, 1H), 5.53 (s, 1H). $^{13}$C NMR (CDCl$_3$, 125 MHz) δ 137.376, 133.201, 130.934, 129.208, 125.359, 123.380, 118.458, 63.006. MS calc'd for [C$_9$H$_6$BrNO] 212.0 found 211.9 (LC-MS+).

4-fluoromandelonitrile: $^1$H NMR (CDCl$_3$, 500 MHz) δ 5.54 (s, 1H), 7.13 (m, 2H), 7.51-7.53 (m, 2H). $^{13}$CNMR (CDCl$_3$, 125 MHz) δ 63.02, 116.44, 118.97, 128.90, 131.54, 132.51, 162.575.

4-chloromandelonitrile: $^1$H NMR (CDC$_3$, 500 MHz) δ 7.47 (d, J=7.0 Hz, 2H), 7.42 (d, J=7.0 Hz, 2H), 5.53 (s, 1H). $^{13}$C NMR (CDCl$_3$, 125 MHz) δ 136.209, 133.845, 129.647, 128.232, 118.630, 63.154. MS calc'd for [C$_8$H$_6$ClNO] 167.01 found 167.9 (LC-MS+)

1-naphthyl cyanohydrin: $^1$H NMR (CDCl$_3$, 500 MHz) δ 8.14 (d, 1H, J=8.5), 7.92 (t, 2H, J=6.1), 7.82 (d, 1H, J=5.7), 7.62 (t, 1H, J=6.1), 7.56 (t, 1H, J=6.1), 7.50 (t, 1H, J=6.1), 6.18 (s, 1H); $^{13}$C NMR (CDCl$_3$, 125 MHz) δ 137.0, 135.7, 134.2, 131.1, 129.2, 127.5, 126.7, 125.8, 125.3, 123.1, 119.0, 62.4; MS calc'd for [C$_{12}$H$_9$O] 183.21, found 183.2 (ESI+).

2-naphthyl cyanohydrin: $^1$H NMR (CDCl$_3$, 500 MHz) δ 8.03 (s, 1H), 7.92 (d, 1H, J=8.6), 7.87-7.91 (m, 2H), 7.61 (dd, 1H, J=6.7, 1.2), 7.55-7.60 (m, 2H), 5.72 (s, 1H); $^{13}$C NMR (CDCl$_3$, 125 MHz) δ 134.9, 133.9, 132.7, 129.6, 128.6, 128.0, 127.4, 127.2, 126.4, 123.9, 118.9, 64.1; MS calc'd for [C$_{12}$H$_9$O] 183.21, found 183.2 (ESI+).

3-pyridyl cyanohydrin: $^1$H NMR (CDCl$_3$, 500 MHz) δ: 8.62 (d, 1H, J=1.8), 8.57 (d, 1H, J=5.1), 7.94 (d, 1H, J=8.1), 7.41 (dd, 1H, J=8.1, 5.1), 5.64 (s, 1H); $^{13}$C NMR (CDCl$_3$, 125 MHz) δ 149.921, 147.355, 135.412, 133.044, 124.443, 118.980, 61.085. MS calc'd for [C$_7$H$_6$N$_2$O] 134.05, found 135.2 (ESI+).

3-thienyl cyanohydrin: $^1$H NMR (CDCl$_3$, 500 MHz) δ 7.45 (d, J=2.2 Hz 1H), 7.56 (dd, J=6.2 Hz, 1H), 7.45 (d, J=5.5 Hz, 1H), 7.32 (t, J=6.4. Hz, 1H), 5.53 (s, 1H). $^{13}$C NMR (CDCl$_3$, 125 MHz) δ 137.376, 133.201, 130.934, 129.208, 125.359, 123.380, 118.458, 63.006. MS calc'd for [C$_6$H$_5$NOS] 139.01 found 139.9 (LC-MS+).

phenyl acetaldehyde cyanohydrin: $^1$H NMR (CDCl$_3$, 500 MHz) δ 7.34 (m, 5H), 4.64 (t, J=6.75 Hz, 1H), 3.11 (d, J=6.75 Hz, 2H), 2.75 (br, 1H): $^{13}$C NMR (CDCl$_3$, 125 MHz) δ 133.96, 129.91, 129.16, 128.08, 119.47, 62.33, 41.55.

2-methylphenyl acetaldehyde cyanohydrin: $^1$H NMR (CDCl$_3$, 500 MHz) δ 7.11 (m, 4H), 4.61 (t, J=6.62 Hz, 1H), 3.12 (d, J=6.62 Hz, 2H), 2.14 (s, 3H) $^{13}$C NMR (CDCl$_3$, 125

MHz) δ 136.94, 136.47, 132.57, 130.48, 127.61, 125.75, 120.11, 62.95, 44.73 MS calc'd for [$C_{10}H_{11}NO$]: 161.08, found 162.2 (M+Na, ESI+).

2-bromophenyl acetaldehyde cyanohydrin: $^1$H NMR (CDCl$_3$, 500 MHz) δ7.20 (m, 4H), 4.78 (t, J=6.5 Hz, 1H), 3.26 (d, J=6.5 Hz, 2H). $^{13}$C NMR (CDCl$_3$, 100 MHz) δ 133.93, 132.82, 131.72, 129.21, 128.12, 124.86, 119.41, 63.02, 44.89.

2-fluorophenyl acetaldehyde cyanohydrin: $^1$H NMR (CDCl$_3$, 500 MHz) δ 7.2 (m, 2H), 7.02 (m, 2H), 4.50 (dd, J=4.62 Hz, J=7.88 Hz, 1H), 3.23 (dd, J=4.62 Hz, J=14.12 Hz, 1H), 2.97 (dd, 7.88 Hz, 14.12 Hz, 1H). $^{13}$C NMR (CDCl$_3$, 125 MHz) δ 132.18, 131.52, 129.66, 129.03, 128.07, 124.05, 115.8, 63.02, 44.79 MS calc'd for [$C_9H_8FNO$] 165.06, found 164.2 (ESI+).

3-methylphenyl acetaldehyde cyanohydrin: $^1$H NMR (CDCl$_3$, 500 MHz) δ 7.18 (m, 1H), 7.02 (m, 3H), 4.54 (dd, J=4.62 Hz, J=8 Hz, 1H), 3.06 (dd, J=4.62 Hz, J=14.38 Hz, 1H), 2.83 (dd, J=8 Hz, J=14.38 Hz, 1H), 2.36 (s, 3H) $^{13}$C NMR (CDCl$_3$, 125 MHz) δ 176.25, 138.18, 136.0, 130.97, 128.93, 127.68, 126.58, 76.42, 34.29, 37.69 MS calc'd for [$C_{10}H_{12}O_3$] 180.08, found 180.0 (ESI+).

3-fluorophenyl acetaldehyde cyanohydrin: $^1$H NMR (CDCl$_3$, 500 MHz) δ 7.18 (m, 2H), 6.95 (m, 2H), 4.44 (dd, 1H), 3.11 (dd, 1H). $^{13}$C NMR (CDCl$_3$, 125 MHz) δ 130.40, 125.53, 124.85, 116.92, 114.87, 114.50, 119.77, 61.97, 41.27.

1-napthyl acetaldehyde cyanohydrin: $^1$H NMR (CDCl$_3$, 500 MHz) δ 8.07 (m, 1H), 7.86 (m, 1H), 7.74 (m, 1H), 7.41 (m, 4H), 4.20 (t, J=7 Hz, 1H), 3.33 (d, J=6.8 Hz, 2H) $^{13}$C NMR (CDCl$_3$, 125 MHz) δ 177.7, 140.31, 129.74, 129.24, 128.92, 128.26, 127.84, 125.63, 124.53, 124.05, 123.42, 70.58, 38.0 MS calc'd for [$C_{13}H_{11}NO$] 197.08, found 197.1 (ESI+).

2-pyridyl acetaldehyde cyanohydrin: $^1$H NMR (CDCl$_3$, 500 MHz) δ 8.50 (m, 1H), 7.85 (m, 1H), 7.48 (m, 1H), 7.34 (m, 1H), 4.42 (m, 1H), 3.19 (dd, J=3.5 Hz, J=13.7 Hz, 2H). $^{13}$C NMR (CDCl$_3$, 125 MHz) δ 157.44, 145.69, 140.24, 126.96, 126.16, 122.99, 60.30, 42.60 MS calc'd for [$C_8H_8N_2O$] 148.06, found 149.1 (ESI+).

3-pyridyl acetaldehyde cyanohydrin: $^1$H NMR (CDCl$_3$, 500 MHz) δ 8.62 (d, 1H, J=1.8), 8.57 (d, 1H, J=5.1), 7.94 (d, 1H, J=8.1), 7.41 (dd, 1H, J=8.1, 5.1), 5.64 (s, 1H). $^{13}$C NMR (CDCl$_3$, 125 MHz) δ: 149.921, 147.355, 135.412, 133.044, 124.443, 118.980, 61.085. Exact Mass calculated for [$C_7H_6N_2O$]: 134.05, found: 135.2 (ESI+).

2-thienyl acetaldehyde cyanohydrin: $^1$H NMR (CDCl$_3$, 500 MHz) δ 7.1 (m, 1H), 6.9 (m, 1H), 6.8 (m, 1H), 4.11 (t, J=7.0 Hz, 1H), 2.86 (d, J=7.0 Hz, 2H). $^{13}$C NMR (CDCl$_3$, 125 MHz) δ 127.68, 127.41, 125.58, 124.60, 118.70, 63.25, 44.84.

3-thienyl acetaldehyde cyanohydrin: $^1$H NMR (CDCl$_3$, 500 MHz) δ 7.09 (m, 3H), 4.60 (t, J=6.25 Hz, 1H), 3.12 (d, J=6.25 Hz, 2H). $^{13}$C NMR (CDCl$_3$, 125 MHz) δ 129.05, 127.16, 125.27, 122.65, 119.87, 61.58, 44.90.

Preparation of racemic mandelic acids standards from corresponding cyanohydrins: (Stoughton, R. W. J. Am. Chem. Soc. 1941, 63, 2376) 2-bromomandelonitrile (230 mg, 1.08 mmol) was dissolved in conc. HCl (1 mL) and stirred at room temperature for 18 h and then at 70° C. for 24 h. After cooling, the reaction mixture was extracted with diethyl ether (4×2 mL). Organic extracts were, combined, dried over MgSO$_4$, filtered and concentrated in vacuo. 2-bromomandelic acid was isolated as a colorless powder (180 mg, 0.78 mmol, 70% yield).

Preparation of racemic aryllactic acids standards from corresponding amino acids: Phenylalanine (10 mmol, 1.65 g) was dissolved in 30 ml 2NH$_2$SO$_4$ at room temperature under N$_2$ (g) atmosphere. Sodium nitrite (1.4 g in 3 ml aqueous solution, 2 eq) solution was added slowly to the reaction mixture over a period of 3-4 hours with vigorous stirring at room temperature under N$_2$ (g) atmosphere. The reaction mixture was stirred overnight and the phenyllacetic acid product was then extracted into diethylether (3×30 ml). Combined ether extracts were dried over MgSO$_4$ and then filtered and concentrated in vacuo. (Kenji, I.; Susumu, A.; Masaru, M.; Yasuyoshi, U.; Koki, Y.; Koichi, K. Patent Number, WO0155074, Publication date: 2001-08-02.)

General Method for Enzymatic Preparation of α-Hydroxy Acids:

(R)-(−)-Mandelic Acid To a solution of mandelonitrile (1.005 g, 7.56 mmol) in 150 mL of sodium phosphate (100 mM) buffer at pH 8 with 10% v/v methanol, that had been N$_2$ (g) sparged, at 37° C., was added 9 mg of nitrilase 1 (normalized for nitrilase content). The reaction was conducted under N$_2$ (g) atmosphere on a rotating platform shaker. Reaction progress was monitored by withdrawing aliquots for HPLC analysis. After 3 h incubation, the reaction mixture was acidified to pH 2 with 1 N HCl and extracted with diethyl ether (4×50 ml). Organic fractions were concentrated in vacuo and then the residue was taken up in 10% sodium bicarbonate solution. This aqueous solutions was then washed with diethyl ether (3×50 ml) and then acidified to pH 2 with 1 N HCl and extracted with diethyl ether (3×50 ml). Organic fractions were combined, washed with brine, dried over MgSO$_4$, filtered and then concentrated in vacuo. (R)-(−)-Mandelic acid (933 mg, 6.22 mmol) was isolated as a colorless powder in 86% yield. $^1$H NMR (DMSO-d$_6$, 500 MHz) δ 12.6 (br, s, 1H) 7.41 (m, 2H), 7.34 (m, 2H), 7.28 (m, 1H), 5.015 (s, 1H). $^{13}$C NMR DMSO-d$_6$, 125 MHz) δ 174.083, 140.216, 128.113, 127.628, 126.628, 72.359. MS calc'd for [$C_8H_8O_3$] 150.07, found 150.9 (ESI+); ee=98% [HPLC]. [α]$^{20}_{598}$=−134.6 (c=0.5, methanol).

(−)-2-chloromandelic acid $^1$H NMR (DMSO-d$_6$, 500 MHz) δ 7.75 (m, 10H), 7.44 (m, 1H), 7.34 (m, 2H), 5.34 (s, 1H). $^{13}$C NMR (DMSO, 298K, 125 MHz) δ 173.070, 137.985, 132.105, 129.399, 129.158, 128.705, 127.235. MS calc'd for [$C_8H_7ClO_3$] 186.0, found 185.0 (LC-MS−). ee=96% [HPLC]. 92% yield. [α]$^{20}_{598}$=−137.6 (c=0.5, ethanol).

(−)-2-bromomandelic acid $^1$H NMR (DMSO-d$_6$, 500 MHz) δ 7.60 (d, J=7.93, 1H), 7.48 (m, 1H), 7.40 (m, 1H), 7.25 (m, 1H), 5.30 (s, 1H). $^{13}$C NMR DMSO-d$_6$, 125 MHz) 3172.994, 139.61, 132.355, 129.652, 128.753, 127.752, 122.681, 71.644. MS calc'd for [$C_9H_7BrO_3$] 230.0, found 230.9. ee=96% [HPLC]. 92% yield. [α]$^{20}_{598}$=−116.4 (c=0.5, ethanol).

(−)-2-methylmandelic acid $^1$H NMR (DMSO-d$_6$, 500 MHz) δ 11.78 (bs, 1H) 7.38 (m, 1H), 7.16-7.38 (m, 3H), 5.18 (s, 1H), 2.35 (s, 3H). $^{13}$C NMR DMSO-d$_6$, 125 MHz) δ 174.229, 138.623, 135.649, 130.129, 127.491, 126.990, 125.698, 125.698, 69.733, 18.899. MS calc'd for [$C_9H_{10}O_3$] 166.1, found 165.2. ee=91% [HPLC]. 86% yield. [α]$^{20}_{598}$=−164.4 (c=0.5, ethanol).

(−)-3-chloromandelic acid $^1$H NMR (DMSO-d$_6$, 500 MHz) δ 7.46 (s, 1H), 7.36 (m, 3H), 5.07 (s, 1H). $^{13}$C NMR (DMSO, 298K, 125 MHz) δ 173.554, 142.685, 132.813, 130.069, 127.568, 126.355, 125.289, 71.659. MS calc'd for [$C_8H_7ClO_3$] 186.0, found 185.34 (MALDI TOF−). ee=98% [HPLC]. 70% yield. [α]$^{20}_{598}$=−120.4 8 (c=0.5, methanol).

(−)-3-bromomandelic acid $^1$H NMR (MSO-d$_6$, 500 MHz) δ 7.60 (s, 1H), 7.49 (m, 1H), 7.42 (m, 1H), 7.31 (m, 1H), 5.06 (s, 1H). $^{13}$C NMR (DMSO, 298K, 125 MHz) δ 173.551, 142.917, 130.468, 130.379, 129.237, 125.687, 121.404, 71.605. MS calc'd for [$C_9H_7BrO_3$] 229.98, found 229.1 (LC-MS). ee=98% [RPLC]. 82% yield. $[\alpha]^{20}_{598}$=−84.8 (c=0.5, ethanol).

(−)-4-fluoromandelic acid $^1$H NMR (DMSO, 298K, 500 MHz) δ 12.65 (s, 1H), 7.44 (m, 2H), 7.17 (m, 2H), 5.91 (s, 1H), 5.03 (s, 1H) $^{13}$C NMR (DMSO, 298K, 125 MHz) δ 173.93, 162.57, 136.47, 128.61, 128.55, 114.96, 114.80, 71.61. MS calc'd for [$C_8H_7FO_3$] 170.0, found 168.8. ee=99% [HPLC]. 81% yield. $[\alpha]^{20}_{598}$=−152.8 (c=0.5, methanol).

(−)-1-naphthylglycolic acid $^1$H NMR (DMSO-$d_6$, 500 MHz) δ 8.28-8.26 (m, 1H), 7.87-7.93 (m, 2H), 7.47-7.58 (m, 4H), 5.66 (s, 1H). $^{13}$C NMR DMSO-$d_6$, 125 MHz) δ 174.288, 136.284, 133.423, 130.654, 128.353, 128.192, 125.926, 125.694, 125.613, 125.266, 124.558, 70.940. MS calc'd for [$C_{12}H_{10}O_3$]: 202.21 found 201.37 (MALDI TOF−). ee=95% [HPLC]. 90% yield $[\alpha]^{20}_{598}$=−115.4 (c=0.5, ethanol).

(−)-2-naphthylglycolic acid $^1$H NMR (DMSO-$d_6$, 500 MHz) δ 12.6 (bm, 1H), 7.88-7.93 (m, 4H), 7.48-7.56 (m, 3H), 5.20 (s, 1H). $^{13}$C NMR DMSO-$d_6$, 125 MHz) δ 174.005, 137.760, 132.644, 132.498, 127.811, 127.658, 127.506, 127.209, 125.993, 125.334, 124.761, 72.472. MS calc'd for [$C_{12}H_{10}O_3$] 202.21, found 201.37 (MALDI TOF). ee=98% [HPLC]. 68% yield. $[\alpha]^{20}_{598}$=−115.4 (c=0.5, ethanol).

(−)-3-pyridylglycolic acid This Reaction was performed in 100 mM ammonium formate buffer at pH 8. To isolate the product, the reaction mixture was filtered through a 10,000 MWCO membrane to remove enzyme and then concentrated in vacuo. $^1$H NMR (DMSO-$d_6$, 500 MHz) δ 8.56 (s, 1H), 8.36 (d, J=4.57 Hz, 1H), 8.25 (s, 1H), 7.71 (m, 1H), 7.25 (dd, J=4.98, 4.80 Hz 1H), 5.45 (s, 1H). $^{13}$C NMR DMSO-$d_6$, 125 MHz) δ 165.911, 147.862, 147.251, 139.118, 133.381, 122.746, 71.508. MS calc'd for [$C_7H_7NO_3$] 153.04, found 154.0 ((MALDI TOF). ee=92% [HPLC], 84% yield, $[\alpha]^{20}_{598}$=−65.2 (c=0.5, $H_2O$).

(−)-3-thienylglycolic acid $^1$H NMR (DMSO-$d_6$, 500 MHz) δ 7.48 (m, 1H), 7.45 (d, J=2.81, 1H), 7.10 (m, 1H), 5.09 (s, 1H), 3.33 (s, 1H), NMR (DMSO, 298K, 125 MHz) δ 173.704, 141.109, 126.446, 126.042, 122.247, 68.915 MS calc'd for [$C_6H_6O_3S$] 158.00, found 157.224 (MALDI TOF). ee=95% [HPLC]. 70% yield. $[\alpha]^{20}_{598}$=−123.2 8 (c=0.5, methanol).

(S)-(−)-phenyllacetic acid $^1$H NMR (DMSO-$d_6$, 500 MHz) δ 7.28 (m, 5H), 4.17 (dd, J=4.5 Hz, J=8.3 Hz, 1H), 2.98 (dd, J=4.5 Hz, J=13.7 Hz, 1H), 2.79 (dd, J=8.3 Hz, J=13.7 Hz, 1H). $^{13}$C NMR (DMSO, 298K, 125 MHz) δ 178.16, 133.4, 129.27, 128.6, 127.3, 70.45, 44.12. ee=97% [HPLC], 84% yield. $[\alpha]^{20}_{598}$=−17.8 (c=0.5, methanol).

(−)-2-methylphenyllacetic acid $^1$H NMR (DMSO-$d_6$, 500 MHz) δ 7.16 (m, 4H), 4.47 (dd, J=3.9 Hz, J=8.8 Hz, 1H), 3.25 (dd, J=3.9 Hz, 14.3 Hz, 1H), 2.94 (dd, J=8.8 Hz, J=14.3 Hz), 2.35 (s, 3H). $^{13}$C NMR (DMSO, 298K, 125 MHz) δ 178.61, 137.08, 134.74, 130.80, 130.25, 127.44, 126.34, 70.93, 37.67, 19.79. MS calc'd [$C_{10}H_{12}O_3$] 180.08, found 180.0 (ESI+). 86% yield. ee=95% [HPLC]. $[\alpha]^{20}_{598}$=−13.2 (c=0.5, methanol).

(−)-2-bromophenyllacetic acid $^1$H NMR (DMSO-$d_6$, 500 MHz) δ 7.28 (m, 4H), 4.60 (dd, J=4.0 Hz, J=9.1 Hz, 1H), 3.45 (dd, J=4.0 Hz, J=14.1 Hz, 1H), 3.04 (dd, J=8.0 Hz, J=14.1 Hz, 1H). $^{13}$C NMR (DMSO, 298K, 125 MHz) δ 178.70, 136.05, 133.21, 132.10, 128.99, 127.72, 125.0, 70.04, 40.76. MS calc'd for [$C_9H_9BrO_3$] 243.9, found 243.3 (ESI+). 91% yield. ee=93% [HPLC], $[\alpha]^{20}_{598}$=−17.6 (c=0.5, methanol)

(−)-2-fluorophenyllacetic acid $^1$H NMR (DMSO, 500 MHz) δ 7.10 (m, 4H), 4.64 (t, J=6.8 Hz, 1H), 3.11 (d, J=6.8 Hz, 2H). $^{13}$C NMR (DMSO, 298K, 125 MHz) δ 132.18, 131.52, 129.66, 129.03, 128.07, 124.05, 115.8, 63.02, 44.79. MS calc'd for [$C_9H_8FNO$]: 165.06, found 164.2 (ESI+). 91% yield. ee=88% [HPLC]. $[\alpha]^{20}_{598}$=−14.0 (c=0.5, methanol).

(−)-3-methylphenyllacetic acid $^1$H NMR (DMSO-$d_6$, 500 MHz) δ 7.18 (m, 1H), 7.02 (m, 3H), 4.54 (dd, J=4.6 Hz, J=8.0 Hz, 1H), 3.06 (dd, J=4.54 Hz, J=14.4 Hz, 1H), 2.83 (dd, J=8.0 Hz, J=14.4 Hz, 1H), 2.36 (s, 3H). $^{13}$C NMR (DMSO, 298K, 125 MHz) δ 175.88, 163.80, 130.33, 130.09, 125.7, 116.68, 113.75, 71.31, 34.28. MS calc'd for [$C_{10}H_{11}NO$] 161.08, found 162.2 (ESI+). 80% yield. ee=98% [HPLC]. $[\alpha]^{20}_{598}$=−2.4 (c=0.5, methanol).

(−)-3-fluorophenyllacetic acid $^1$H NMR (DMSO-$d_6$, 500 MHz) δ 7.2 (m, 1H), 6.9 (m, 3H), 4.56 (dd, 4.5 Hz, J=7.9 Hz, 1H), 3.09 (dd, J=4.5 Hz, J=14.1 Hz, 1H), 2.86 (dd, J=7.9 Hz, J=14.1 Hz, 1H). $^{13}$C NMR (DMSO, 298K, 125 MHz) δ 175.88, 163.80, 130.33, 130.09, 125.7, 116.68, 113.75, 71.31, 34.28. MS calc'd for [$C_9H_9O_3F$] 184.05, found 184.1 (ESI+). 82% yield. ee=97% [HLC]. $[\alpha]^{20}_{598}$=−5.2 (c=0.5, methanol).

(−)-1-napthyllactic acid $^1$H NMR (DMSO-$d_6$, 500 MHz) δ 8.57 (m, 1H), 8.21 (m, 1H), 8.08 (m, 1H), 7.61 (m, 4H), 4.64 (dd, 3.5 Hz, 8.5 Hz, 1H), 3.84 (dd, J=3.5 Hz, J=14.5 Hz, 1H), 3.38 (dd, J=8.5 Hz, J=14.5 Hz, 1H) $^{13}$C NMR (DMSO, 298K, 125 MHz) δ 177.7, 140.31, 129.74, 129.24, 128.92, 128.26, 127.84, 125.63, 124.53, 124.05, 123.42, 70.58, 38.0. MS calc'd for [$C_{13}H_{11}NO$] 197.08, found 197.1 (ESI+). 87% yield. ee=94% [HPLC]. $[\alpha]^{20}_{598}$=−16.2 (c=0.5, methanol).

(−)-2-pyridylactic acid $^1$H NMR (DMSO-$d_6$, 500 MHz) δ 8.49 (m, 1H), 7.62 (m, 1H), 7.21 (m, 2H), 4.50 (t, J=5.0 Hz, 1H), 3.01 (d, J=5.0 Hz, 2H). $^{13}$C NMR (DMSO, 298K, 125 MHz) δ 178.8, 159.79, 148.84, 136.89, 124.35, 121.75, 71.14, 44.09. MS calc'd for [$C_8H_9NO3$]: 167.06, found 167.0. (ESI+). 62% yield. ee=94% [HPLC], $[\alpha]^{20}_{598}$=−3.6 (c=0.5, methanol).

(−)-3-pyridyllactic acid $^1$H NMR (DMSO-$d_6$, 500 MHz) δ 8.43 (m, 2H), 7.62 (m, 1H), 7.28 (m, 1H), 4.57 (t, 5.37 Hz, 1H), 2.85 (d, 5.37 Hz, 2H). $^{13}$C NMR (DMSO, 298K, 125 MHz) δ 176.6, 150.03, 147.12, 136.41, 129.45, 123.26, 61.56, 31.46 MS calc'd for [$C_8H_9NO_3$] 167.06, found 167.0 (ESI+). 59% yield. ee=94% [HPLC]. $[\alpha]^{20}_{598}$=−4.0 (c=0.5, methanol).

(−)-2-thienyllactic acid $^1$H NMR (DMSO-$d_6$, 500 MHz) δ 7.18 (m, 1H), 6.94 (m, 1H), 6.90 (m, 1H), 4.49 (dd, J=4.1 Hz, J=6.25 Hz, 1H), 3.36 (dd, J=4.1 Hz, J=15.0 Hz, 1H), 3.26 (dd, J=6.25 Hz, J=15.0 Hz, 1H). $^{13}$C NMR (DMSO, 298K, 125 MHz) δ 127.68, 127.41, 125.58, 124.60, 118.70, 63.25, 44.84. MS calc'd for [$C_7H_7NOS$] 153.02, found 153.0 (ESI+). 85% yield. ee=95% [HPLC]. $[\alpha]^{20}_{598}$=−13.0 (c=0.5, methanol).

(−)-3-thienyllactic acid $^1$H NMR (DMSO-$d_6$, 500 MHz) δ 7.30 (m, 1H), 7.13 (m, 1H), 7.01 (m, 1H), 4.50 (dd, J=4.25 Hz, J=6.5 Hz, 1H), 3.21 (dd, J=4.25 Hz, J=15.0 Hz, 1H), 3.10 (dd, J=6.5 Hz, J=15.0 Hz, 1H). $^{13}$C NMR DMSO, 298K, 125 MHz) δ 127.50, 136.09, 128.83, 126.24, 123.32, 70.65, 34.84. MS calc'd for [$C_7H_8O_3S$] 172.02, found 172.1 (ESI+). 81% yield. ee=96% [HPLC]. $[\alpha]^{20}_{598}$=−18.8 (c=0.5, methanol).

Enzymatic Hydrolysis of 3-Hydroxyglutarylnitrile:

3-Hydroxyglutarylnitrile (1.0 g, 9.0 mmol, 240 mM) was suspended in $N_2$ (g) sparged sodium phosphate buffer (37.5 mL, pH 7, 100 mM) at room temperature. Cell lysate (30 mg, normalized for nitrilase content) was added to bring the concentration to 0.8 mg/ml enzyme and the reaction was at shaken at 100 rpm, room temperature. Reaction progress was monitored by TLC (1:1 EtOAc:Hexanes, $R_f$=0.32, nitrile; $R_f$=0.0, acid) After 22 h, the reaction was acidified with 1M HCl. The reaction mixture was continuously extracted with diethyl ether. The acid product was isolated as a yellow oil (1.15 g, 98% yield). $^1$H NMR (DMSO, 298K, 500 MHz) δ 12.32 (s, 1H), 5.52 (s, 1H), 4.10 (m, 1H), 2.70 (dd, 1H, J=16.8, 4.1 Hz), 2.61 (dd, 1H, J=16.9, 6.3 Hz), 2.44 (dd, 1H, J=15.4, 5.3 Hz), 2.37 (dd, 1H, J=15.6, 7.8 Hz). $^{13}$C NMR (DMSO, 298K, 125 MHz) δ 171.9, 118.7, 63.4, 41.2, 25.2 MS calc'd for [$C_5H_7NO_3$]: 129.0, found 130.0 [M+H$^+$], (ESI+).

Preparation of (R)-(−)-Methyl (3-O-[benzoyl]-4-cyano)-butanoate

Benzoyl chloride (0.068 ml, 0.752 mmol) was added to a stirred solution of (R)-methyl-(3-hydroxy-4-cyano)-butanoate (71.7 mg, 0.501 mmol) in pyridine (2.0 ml), at room temperature. After 19 hours, add an additional 0.5 equivalent of benzoyl chloride (0.023 ml, 0.251 mmol). Reaction was complete at 23 h, as determined by TLC. Add 1 ml H$_2$O, extract with ether (3×10 ml). Wash with brine (2×10 ml). Dry combined aqueous extracts with MgSO$_4$. Filter off drying agent and remove solvent by rotary evaporation. Purify by column chromatography (hexane:ethyl acetate [2:1]. Rotary evaporation of fractions yielded the product as a yellow oil (46 mg, 0.186 mmol, 37%). $^1$H NMR (DMSO, 298K, 500 MHz) δ 7.96 (d, 2H, J=7.8), 7.70 (t, 1H, J=7.25), 7.56 (t, 2H, J=7.8), 5.55 (m, 1H), 3.59 (s, 3H), 3.13 (m, 2H), 2.90 (m, 2H). $^{13}$C NMR (DMSO, 298K, 125 MHz) δ 169.6, 164.5, 133.8, 129.3, 128.9, 128.5, 117.3, 66.0, 51.8, 37.5, 22.2 MS calc'd for [C$_{13}$H$_{13}$NO$_4$]: 247.25, found 270.3 [M+Na$^+$] ee=95% [HPLC]. [α]$^{20}_{598}$−32.4 (c=0.5, CHCl$_3$).

Synthesis of (R)-Ethyl-(3-hydroxy-4cyano)-butanoate

A 0.2 M solution of (R)-3-hydroxy-4-cyano-butanoic acid (50 mg, 0.387 mmol) in anhydrous ethanol (1.94 mL) was prepared. The ethanol solution was added dropwise to 1.0 ml of a 50:50 (v/v) mixture of anhydrous 1 M HCl ethereal solution and anhydrous ethanol over sieves. The reaction was stirred overnight at room temperature under N$_2$ (g) atmosphere. The reaction was monitored by TLC, (1:1 EtOAc: Hexanes, R$_f$=0.45, ester; R$_f$=0.0, acid, stained with p-anisaldehyde). After 30 hrs, solvent was removed by rotary evaporation. The crude product was taken up in 25 mL ether, washed with 5 mL saturated bicarbonate and then 5 mL brine. The organic extract was dried over MgSO$_4$, filtered and then concentrated in vacuo, yielding the product as a clear oil. $^1$H NMR (DMSO, 298K, 500 MHz) δ 5.60 (d, 1H, J=5.58 Hz), 4.12 (m, 1H), 4.07 (q, 2H, J=7.1), 2.66 (m, 2H), 2.47 (m, 2H), 1.87 (t, 3H, J=7.0). $^{13}$C NMR (DMSO, 298K, 125 MHz) δ 170.21, 118.60, 63.40, 59.98, 41.10, 25.14, 14.02. MS calc'd for [C$_7$H$_{11}$NO$_3$]: 157.1, found 158.2. [M+H$^+$]

Example 13

Optimization of Nitrilases for the Enantioselective Production of (R)-2-Chloromandelic Acid Chloromandelic acid has the structure:

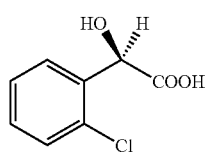

Nitrilases were identified which selectively produced (2)-2-chloromandelic acid from (R,S)-2-chloromandelonitrile. Nitrilases were identified which were useful to improve the enantioselectivity of the enzymes and establishing the effects of process conditions on the enzymes. An examination of the reaction conditions for the enzymatic nitrile hydrolysis was carried out in order to improve the enantiomeric excess of the product. Additionally, further investigation into the effects of process conditions on the enzyme was performed.

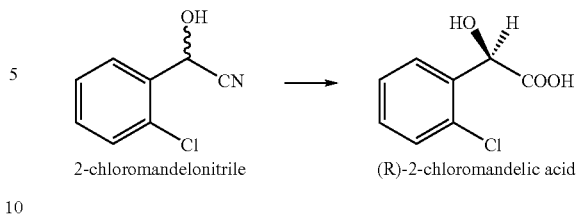

2-chloromandelonitrile    (R)-2-chloromandelic acid

In this aspect, the enantioselective production of (R)-2-chloromandelic acid was the target. One enzyme, SEQ ID NOS:385, 386, was selected for further confirmation of its enantioselectivity on 2-chloromandelonitrile. SEQ ID NOS: 385, 386 was shown to be stable to process components, with a half-life of 8 hours. The enzyme was inhibited by 2-chlorobenzaldehyde and a contaminant in the cyanohydrin substrate, 2-chlorobenzoic acid. The enzymatic reaction was scaled up to a substrate concentration of 45 mM 2-chloromandelonitrile. Over 90% conversion was obtained, with ee of 97%. The chiral HPLC method was improved, to remove a contaminating peak that was present in the substrate. Improved accuracy in the determination of enantioselectivity was obtained using this method.

Nitrilases were screened against 2-chloromandelonitrile, with 31 nitrilases exhibiting activity on this substrate. High enantioselectivities were shown by 9 enzymes. The optimization of 5 of these enzymes was undertaken and one of them was identified as a candidate for the next stage of development.

In an effort to improve the enantioselectivity of the selected enzymes for (R)-2-chloromandelic acid, a number of factors that are known to affect this property, together with the activity of the enzymes, were investigated. These included pH, temperature, buffer strength and addition of solvents to the reaction. Initially, 5 nitrilases were selected for these studies, based on the high enantioselectivities obtained by these enzymes. These enzymes were: SEQ ID NOS:385, 386, SEQ ID NOS:197, 198, SEQ ID NOS:217, 218, SEQ ID NOS:55, 56, and SEQ ID NOS:167, 168.

Effect of pH

The enzymatic reactions were run at a range of pH values, from pH 5 to pH 9. An increase in both activity and enantioselectivity with increasing pH was observed for all of the enzymes. With the exception of SEQ ID NOS:385, 386, pH 9 (0.1 M Tris-HCl buffer) was determined as the optimum for activity and enantioselectivity. The optimum pH for SEQ ID NOS:385, 386 was pH 8 (0.1 M sodium phosphate buffer).

Effect of Temperature

The enzymes exhibited similar temperature profiles, with the highest activities being measured at 37° C. and 45° C. Although the latter temperature resulted in higher conversions, the enantioselectivity of most of the enzymes showed a clear preference for the lower temperatures, with ee values being 10-20% lower when the temperature was raised above 37° C. In the case of SEQ ID NOS:385, 386 a slight optimum for enantioselectivity was evident at 37° C. Therefore, this temperature was established as the optimum for hydrolysis of 2-chloromandelonitrile by these enzymes.

Effect of Enzyme Concentration

During the concurrent investigation into the enantioselective hydrolysis of phenylacetaldehyde cyanohydrin to L-phenyllacetic acid, the concentration of the enzyme in the reaction was found to have a significant effect on the enantioselectivity of the reaction. This provided an indication that the enzymatic hydrolysis rate was faster than the rate of racemization of the remaining cyanohydrin in the reaction. On this basis, the effect of enzyme concentration on the enantioselectivity of the enzymes towards (R)-2-chloromandelonitrile was investigated. Enzymatic reactions were performed with the standard concentration of enzyme (0.6 mg protein/ml), half the standard concentration and one-tenth of the standard concentration.

The following Table indicates the highest conversions achieved for the reactions, with the corresponding ee. With the exception of SEQ ID NOS:385, 386, it appears that very little, if any, increased enantioselectivity is observed. Therefore, it appears that the rate of racemization of the remaining chloromandelonitrile is not a limiting factor to obtaining higher enantioselectivities.

Investigation of Other Positive Enzymes

In addition to the enzymes in the above Table, a number of other nitrilases were screened for their enantioselectivities on 2-chloromandelonitrile. Some of these enzymes were newly discovered enzymes. Some were reinvestigated under conditions that have since been found to be optimal for these enzymes (pH 8 and 37° C.). The results of this screening are shown below in the Table.

Effect of Co-Solvent Concentration

The addition of methanol as a cosolvent in the enzymatic reactions was shown to enhance the ee. In order to establish the lowest level of methanol that could be added to the reactions, the enzyme reactions were performed at varying concentrations of methanol, ranging from 0-20% (v/v). No significant differences in enantioselectivity were evident between the various methanol concentrations. However, the ee in these reactions was 97-98%, while that of the control reaction, with no added methanol was 95-96%. While this difference in ee is small, the effect of the methanol was shown in more than one set of experiments during the course of this investigation and is therefore regarded as significant. Effect of reaction components on activity of SEQ ID NOS:385, 386

A vital part of an investigation into process optimization of an enzyme involves the determination of the effects of any compounds which could be present in the enzymatic reaction. For SEQ ID NOS:385, 386, these components were established as the starting material and equilibrium product of the cyanohydrin, 2-chlorobenzaldehyde; the product, 2-chloromandelic acid and the contaminant detected in the substrate, 2-chlorobenzoic acid. The addition of cyanide to the reaction was found to have no effect on the enzyme activity. The presence of trace amounts of triethylamine was also found to be tolerable to the enzyme.

The effect of the various reaction components on the activity of SEQ ID NOS:385, 386 was assessed by addition of various levels of possible inhibitors to the enzyme reaction. From these experiments, it appeared that both the aldehyde and its oxidation product, 2-chlorobenzoic acid were detrimental to enzyme activity. Approximately 70% and 40% of the activity of SEQ ID NOS:385, 386 was lost upon addition of 5 mM 2-chlorobenzaldehyde or 5 mM 2-chlorobenzoic acid to the reaction, respectively.

Scale-Up Hydrolysis of 2-Chloromandelonitrile

In order to confirm the conversion and enantioselectivity obtained by SEQ ID NOS:385, 386 for the production of (R)-2-chloromandelic acid, a larger scale reaction was performed and the product isolated from the aqueous mixture. The reaction was performed in a 20 ml reaction volume, with a substrate concentration of 45 mM 2-chloromandelonitrile. Complete conversion of the cyanohydrin was obtained, with 30 mM product formed. The ee of the product was 97% and the specific activity of the enzyme was 0.13 mmol product/mg nitrilase/h.

It is evident from this experiment, together with the other experiments performed, that the formation of product does not account for the complete loss of substrate. In all experiments, a nitrile-containing control sample was run, in order to determine the extent of breakdown of the cyanohydrin. Overall, it appears that approximately 50% of the substrate is lost over a period of 4 hours at 37° C. It is expected that this breakdown would be to its equilibrium products, cyanide and 2-chlorobenzaldehyde, which could undergo further oxidation. A larger scale reaction was also run at a substrate concentration of 90 mM 2-chloromandelonitrile. However, no product was detected in this reaction. At higher substrate concentrations, it is expected that the concentration of the equilibrium product, 2-chlorobenzaldehyde and the contaminant, 2-chlorobenzoic acid will be present in higher amounts. Based on the results above, it is possible that the enzyme will be completely inhibited under such conditions.

Reactions Under Biphasic Conditions

The use of biphasic systems can facilitate product recovery following the enzymatic reaction step. These systems can be also be used for the removal of products or by-products which are inhibitory to the enzyme. The nitrilases were shown to be active under biphasic conditions using a variety of solvents. Following the low conversions obtained at the higher substrate concentration above, further investigation of a biphasic system was performed with the hit enzyme, SEQ ID NOS: 385, 386. It was important to ascertain whether any inhibitory factors could be removed by the solvent phase and whether any process advantages could be gained by the use of a biphasic system.

Promising results were obtained with hexane as the organic phase. Therefore, further investigations involved the use of this solvent at two different levels: 100% and 70% of the volume of the aqueous phase, with increasing substrate concentrations, up to 90 mM. The substrate was dissolved in the organic phase. The level of hexane did not appear to affect the level of product formation, particularly at the higher concentrations of 2-chloromandelonitrile.

Once again, high conversion was observed in a biphasic system, with a 76% yield of product being observed after 5 hours. The rate of product formation appeared to be slightly lower than in the corresponding monophasic system, where the reaction is complete within 1 hour. Lower enantioselectivity was observed in the biphasic system. Some possibilities which may account for these results are (i) the mass transfer rate is lower than the rate of enzyme activity or (ii) the non-polar solvent directly affects the enzyme.

At a higher substrate concentration, a very low conversion was observed, with 7 mM 2-chloromandelic acid being formed from 90 mM 2-chloromandelonitrile. This level of conversion, albeit low, was higher than that observed in the monophasic system with the same substrate concentration. These results suggest that some of the inhibitory 2-chlorobenzaldehyde or 2-chlorobenzoic acid is retained in the non-polar organic solvent.

Standard Assay Conditions:

The following solutions were prepared:

Substrate stock solution: 50 mM of the cyanohydrin substrate in 0.1 M phosphate buffer (pH 8).

Enzyme stock solution: 3.33 ml of 0.1 M phosphate buffer (pH 8) to each vial of 20 mg of lyophilized cell lysate (final concentration 6 mg protein/ml)

The reaction volumes varied between the different experiments, depending on the number of time points taken. Unless otherwise noted, all reactions consisted of 25 mM 2-chloromandelonitrile and 10% (v/v) of the enzyme stock solution (final concentration 0.6 mg protein/ml). The reactions were run at 37° C., unless otherwise stated. Controls to monitor the nitrile degradation were run with every experiment. These consisted of 25 mM 2-chloromandelonitrile in 0.1 M phosphate buffer (pH 8).

Sampling of reactions: The reactions were sampled by removing an aliquot from each reaction and diluting these samples by a factor of 8. Duplicate samples were taken for analysis by chiral and achiral HPLC methods. The reactions were sampled at 0.5, 1, 1.5, 2, 3, and 4 hours, unless otherwise shown in the figures above.

HPLC Methods

The achiral HPLC method was run on a SYNERGI-RP™ column (4 µM; 50×2 mm) with a mobile phase of 10 mM Na phosphate buffer (pH 2.5). A gradient of methanol was introduced at 3.5 min and increased to 50% over 1.5 min, following which the methanol was decreased to 0%. Elution times for 2-chloromandelic acid and 2-chloromandelonitrile were 2.5 and 6.1 minutes, with another peak appearing with the nitrile at 5.9 minutes.

As described above, the chiral HPLC method was optimized during the course of the investigation, to improve the separation between 2-chlorobenzoic acid and (S)-2-chloromandelic acid. The optimized method was used during the latter half of the investigation and was run on a CHROBIOTIC-R™ column. The mobile phase was 80% Acetonitrile: 20% of 0.5% (v/v) acetic acid. Elution times for (S)-2-chloromandelic acid and (R)-2-chloromandelic acid were 2.4 and 3.5 minutes respectively. A peak for 2-chlorobenzoic acid eluted at 1.9 minutes. For each experiment, a standard curve of the product was included in the HPLC run. The concentration of product in the samples was calculated from the slope of these curves.

Effect of pH

The effect of pH on the enzyme activity and enantioselectivity was studied by performance of the standard assay in a range of different buffers: 0.1 M Citrate Phosphate pH 5; 0.1 M Citrate Phosphate pH 6; 0.1 M Sodium Phosphate pH 6; 0.1 M Sodium Phosphate pH 7; 0.1 M Sodium Phosphate pH 8; 0.1 M Tris-HCl pH 8; and 0.1 M Tris-HCl pH 9. The standard enzyme concentration was used for all enzymes, with the exception of SEQ ID NOS:385, 386, where half the standard concentration was used (5% v/v of the enzyme stock solution).

Effect of Temperature

The effect of temperature on the activity and enantioselectivity was investigated by performing the standard assay at a range of different temperatures: room temperature, 37° C., 45° C., 50° C. and 60° C. The standard enzyme concentration was used for all enzymes, with the exception of SEQ D NOS:385, 386, where half the standard concentration was used (5% v/v of the enzyme stock solution).

Effect of Enzyme Concentration

Reactions were run under standard conditions, with varying enzyme concentrations: 1%, 5% and 10% (v/v) of the enzyme stock solution. The reaction volume was normalized with the appropriate buffer.

Addition of Solvents

The enzyme reactions were performed in the presence of methanol as a cosolvent. Methanol was added to the standard reaction mixture at the following levels: 0, 5, 10, 15 and 20% (v/v).

Biphasic reactions with hexane were also investigated. The aqueous phase contained 10% (v/v) of the enzyme stock solution in 0.1 M phosphate buffer (pH 8). The cyanohydrin was dissolved in the hexane, prior to addition to the reaction. Two levels of organic phase were used: 1 equivalent and 0.7 equivalents of the aqueous phase volume. In addition, a range of nitrile concentrations was investigated: 25, 45 and 90 mM. These reactions were run at room temperature.

Samples from these reactions were taken both from the aqueous and the solvent phase. The hexane was evaporated by centrifugation under vacuum and redissolved in a 50:50 mixture of methanol and water, so that the samples were at the same dilution as the aqueous samples. Analysis of the samples was performed by non-chiral and chiral HPLC.

Effect of Process Components (i) Activity: The effect of the process components on the activity of the enzymes was established by addition of the individual components, 2-chlorobenzaldehyde, 2-chlorobenzoic acid or 2-chloromandelic acid, to the enzymatic reaction. The enzymatic reactions were carried out under standard conditions, in the presence of one of the 2 possible inhibitors as follows: 5, 10, 20 and 25 mM 2-chlorobenzaldehyde; 1.5 and 5 mM 2-chlorobenzoic acid; and 10, 20, 40 and 80 mM 2-chloromandelic acid. Control reactions were performed under standard conditions, with no additive. At each of the sampling times, the samples were diluted to a level of 1 in 10. Control samples containing the reaction components without enzyme were used and diluted to the same level. The samples were analysed by non-chiral HPLC.

(ii) Stability: The stability of the enzymes to process conditions was monitored by incubation of the enzymes in the presence of the reaction components, 2-chlorobenzaldehyde and 2-chloromandelic acid for predetermined time periods, prior to assay of the enzyme activity under standard conditions. In these experiments, the enzymes were incubated at a concentration of 3 mg protein/ml in the presence of each of the following reaction components: 5, 10, 20 and 25 mM 2-chlorobenzaldehyde; and 10, 20, 40 and 80 mM 2-chloromandelic acid. Control reactions were performed by incubation of the enzyme in buffer only.

Assay conditions: At 0, 4, 8 and 24 hours of incubation in the particular additive, 20 µl of the enzyme solution was removed and added to 60 µl of a 41.6 mM substrate stock solution and 20 µl buffer. The enzyme activity was thus assayed under standard conditions. The reactions were sampled 90 minutes after substrate addition and analyzed using the non-chiral HPLC method.

Scale-Up of Enzymatic Reaction

The enzymatic reactions were run at two difference concentrations: 45 mM and 90 mM substrate. The reactions were run under standard conditions, i.e. pH 8 (0.1 M sodium phosphate buffer), 37° C. and 10% (v/v) of the enzyme stock solution. The substrate was dissolved in 10% (v/v/) methanol

Example 14

Optimization of Nitrilases for the Enantioselective Production of L-2-amino-6,6-dimethoxyhexanoic acid

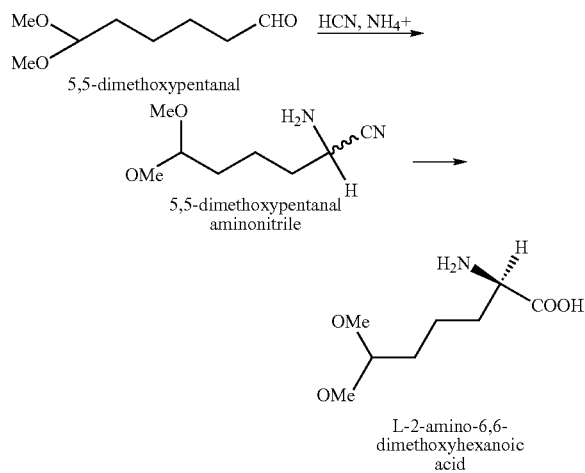

Four of the isolated enzymes were shown to hydrolyze 2-amino-6-hydroxy hexanenitrile to (S)-2-amino-6-hydroxy hexanoic acid, with selectivity towards the L-enantiomer. A new target, with a similar structure to (S)-2-amino-6-hydroxy hexanoic acid was identified. A panel of the isolated nitrilases are screened against the target, 5,5-dimethoxypentanal aminonitrile. The positive enzymes are characterized on this substrate. Laboratory evolution techniques can be used to optimize these nitrilases for improved enantiospecificity towards the specified target. A primary screen is used to identify putative up-mutants, which is conformed using HPLC.

Optimization of enzymes: GSSM™ and GeneReassembly™ can be performed on selected nitrilases, in order to improve the enantioselectivity and activity of the enzymes for the production of L-2-amino-6,6-dimethoxyhexanoic acid. Four enzymes were identified that can hydrolyze enantioselectively 2-amino-6-hydroxy hexanenitrile to L-(S)-2-amino-6-hydroxy hexanoic acid. However, a slight structural difference is present in the new target molecule, L-2-amino-6,6-dimethoxyhexanoic acid. In order to determine whether this difference affects the activity and enantioselectivity of the enzymes, the complete spectrum of nitrilases is screened against the new target.

An enzyme exhibiting the highest combination of activity and enantioselectivity for the production of L-2-amino-6,6-dimethoxyhexanoic is selected for GSSM™. Following the mutation of the target enzyme, the resulting mutants will be screened on 5,5-dimethoxypentanal aminonitrile, using high throughput screening technology. Following confirmation of the up-mutants by HPLC analysis, the individual up-mutants will be combined in order to further enhance the properties of the mutant enzymes.

In parallel to GSSM™, a GeneReassembly™ can be performed on a combination of parent enzymes, at least one of which can be selected for activity and enantioselectivity on L-2-amino-6,6-dimethoxyhexanoic acid. At least two other nitrilases, with a high degree of homology, can be reassembled with the former enzyme(s); these enzymes will be selected in order to provide diversity to the reassembled sequences.

Crucial to the success of this evolution effort is the development of a high throughput assay for enantioselectivity. Such an assay is a novel enzyme-based enantioselectivity assay that allows for the screening of >30,000 mutants in a significantly shorter time period than the traditionally used method of HPLC.

In one aspect, a non-stochastic method, termed synthetic ligation reassembly, that is related to stochastic shuffling, except that the nucleic acid building blocks are not shuffled or concatenated or chimerized randomly, but rather are assembled non-stochastically, can be used to create variants. This method does not require the presence of high homology between nucleic acids to be shuffled. The ligation reassembly method can be used to non-stochastically generate libraries (or sets) of progeny molecules having at least $10^{100}$ or at least $10^{1000}$ different chimeras. The ligation reassembly method provides a non-stochastic method of producing a set of finalized chimeric nucleic acids that have an overall assembly order that is chosen by design, which method is comprised of the steps of generating by design a plurality of specific nucleic acid building blocks having serviceable mutally compatible ligatable ends, as assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized, recombined or shuffled.

In one exemplification, the invention provides for the chimerization of a family of related genes and their encoded family of related products. In a particular exemplification, the encoded products are nitrilase enzymes. Nucleic acids encoding the nitrilases of the invention can be mutagenized in accordance with the methods described herein.

Thus, according to one aspect of the invention, the sequences of a plurality of progenitor nucleic acid templates encoding nitrilases are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates, and preferably at almost all of the progenitor templates. Even more preferably still a serviceable demarcation point is an area of homology that is shared by all of the progenitor templates.

In a one aspect, the ligation reassembly process is performed exhaustively in order to generate an exhaustive library. In other words, all possible ordered combinations of the nucleic acid building blocks are represented in the set of finalized chimeric nucleic acid molecules. At the same time, the assembly order (i.e., the order of assembly of each building block in the 5' to 3' sequence of each finalized chimeric nucleic acid) in each combination is by design (or non-stochastic, non-random). Because of the non-stochastic nature of the method, the possibility of unwanted side products is greatly reduced.

In another aspect, the method provides that, the ligation reassembly process is performed systematically, for example in order to generate a systematically compartmentalized library, with compartments that can be screened systematically, e.g., one by one. Each compartment (or portion) holds chimeras or recombinants with known characteristics. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible, yet exhaustive and systematic, particularly when there is a low level of homology among the progenitor molecules, the invention described herein provides for the generation of a library (or set) comprised of a large number of progeny molecules. Because of the non-stochastic nature of the ligation reassembly method, the progeny molecules generated preferably comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In another exemplification, the synthetic nature of the step in which the building blocks are generated allows the design and introduction of nucleotides (e.g., one or more nucleotides, which may be, for example, codons or introns or regulatory sequences) that can later be optionally removed in an in vitro process (e.g., by mutageneis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

The synthetic ligation reassembly method of the invention utilizes a plurality of nucleic acid building blocks, each of which preferably has two ligatable ends. The two ligatable ends on each nucleic acid building block may be two blunt ends (i.e. each having an overhang of zero nucleotides), or preferably one blunt end and one overhang, or more preferably still two overhangs. On a double-stranded nucleic acid, a useful overhang can be a 3' overhang, or a 5' overhang. A nucleic acid building block can have a 3' overhang, a 5' overhang, two 3' overhangs, or two 5' overhangs. The overall order in which the nucleic acid building blocks are assembled to form a finalized chimeric nucleic acid molecule is determined by purposeful experimental design (e.g., by designing sticky ends between building block nucleic acids based on the sequence of the 5' and 3' overhangs) and is not random.

According to one preferred aspect, a nucleic acid building block is generated by chemical synthesis of two single-stranded nucleic acids (also referred to as single-stranded oligos) and contacting them together under hybridization conditions so as to allow them to anneal to form a double-stranded nucleic acid building block. A double-stranded nucleic acid building block can be of variable size. The sizes of these building blocks can be small or large. Preferred sizes for building block range from 1 base pair (not including any overhangs) to 100,000 base pairs (not including any overhangs). Other preferred size ranges are also provided, which have lower limits of from 1 bp to 10,000 bp (including every integer value in between), and upper limits of from 2 bp to 100,000 bp (including every integer value in between).

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. Preferably the codon degeneracy is introduced using the site-saturation mutagenesis described herein, using one or more N,N,G/T cassettes or alternatively using one or more N,N,N cassettes.

Example 15

Assays for Evaluation of Nitrilase Activity and Enantioselectivity

An assay method amenable to high throughput automation to increase the screening throughput both of the discovery and evolution efforts for nitrilases is described. The ideal assay is one that permits quantification of both product formation or substrate conversion and also enantiomeric excess. Two achiral and two chiral colorimetric assays that are amenable to high throughput screening were developed.

Achiral Colorimetic Assays Developed:

OPA assay for residual substrate. The OPA assay is Applicable to α-amino or α-hydroxy nitrile substrates. The lysis of whole cells is not necessary. These results were corroborated by HPLC for 2-chloromandelonitrile and phenyl acetaldehyde cyanohydrin. The assay works best with aromatic nitrites. Aliphatic compounds exhibit a linear standard curve, fluorescence is reduced, reducing the efficacy of the assay.

LDH Assay for quantification and ee determination of hydroxyacid formed. The LDH assay is applicable to phenyl lactic acid but not to 2-chloromandelic acid. Use of a resazurin detection system increases sensitivity and reduces background. Background fluorescence of whole cells was overcome either by centrifugation or heat inactivation prior to performing assay.

AAO Assay for quantification and ee determination of aminoacid formed. The AAO assay is applicable to phenylalanine and (S)-2-amino-6-hydroxy hexanoic acid. The use of the Amplex Red detection system increases sensitivity. Cell lysis was shown not be necessary. Cells are grown in defined media in order to prevent background fluorescence.

OPA Assay

The o-phthalaldehyde (OPA) fluorescence based nitrilase assay is used to quantify the amount of α-hydroxynitrile substrate remaining. OPA reacts with the cyanide released from the pH controlled decomposition of α-hydroxynitriles to the corresponding aldehyde and cyanide to yield a fluorescent, quantifiable product. OPA reacts with the cyanide released from the pH controlled decomposition of α-hydroxynitriles to the corresponding aldehyde and cyanide to yield the fluorescent 1-cyano-2-R benzoisoindole.

mine sensitivity and background fluorescence, a lyophilized nitrilase lysate (SEQ ID NOS:189, 190) with suspected catalytic activity on each of the substrates was added. Hydrolysis was detected in three out of four of the compounds. NDA sharply boosted the signal, often by an order of magnitude, though this reduced linearity is presumably due to signal saturation.

NDA was established as an alternative detection reagent for the aliphatic compounds. However, it is desirable for the assay to utilize the same detection system for all of the substrates since this would facilitate the automated evaluation of multiple nitrilase substrates. The current OPA based assay is effective for the analysis of PAC, CMN, CHMN, APA, MN

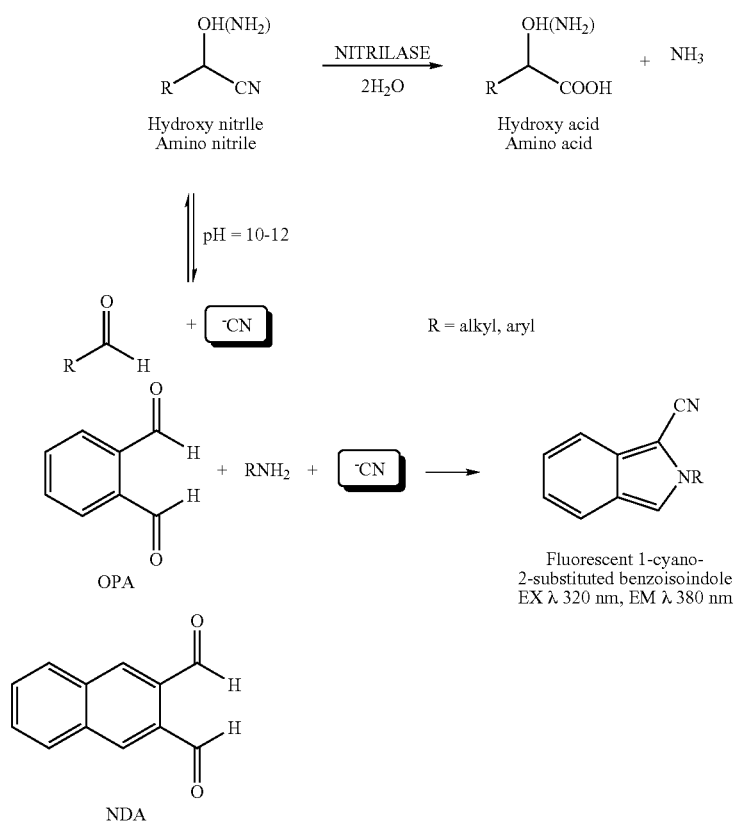

Figure 5:
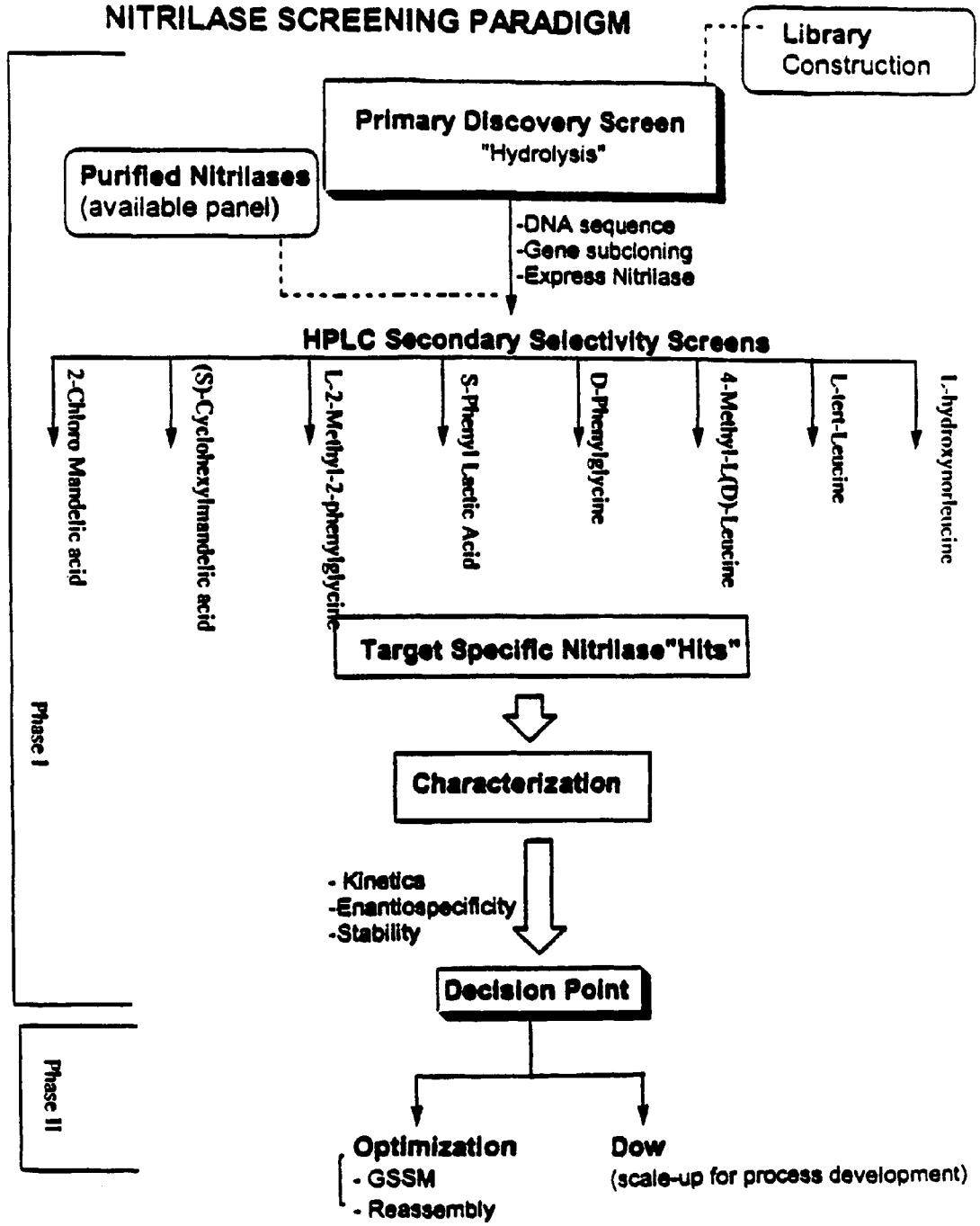
FIG. 5 is a flow diagram illustrating the steps of a nitrilase screening method.

Standard curves were established for the following substrates: 2-Chloromandelonitrile (CMN, 0.998), Cyclohexylmandelonitrile (CHMN, 0.99), Acetophenone aminonitrile (APA, 0.99), and Phenylacetaldehyde cyanohydrin (PAC, 0.97), (FIG. 5), ($R^2$ values in parentheses). A standard curve for Phenylglycine (PGN, 0.93) was also established. Three of the substrates tested, Dimethylbutanal aminonitrile (DMB) (2-amino-4,4-dimethyl pentanenitrile), Hydroxypivaldehyde aminonitrile (HPA) and Pivaldehyde aminonitrile (PAH), gave very low fluorescence readings and unreliable results under the original assay conditions. For these compounds a number of parameters where adjusted, however the fluorescent signal strength of these compounds was not increased by these manipulations.

In an attempt to increase the fluorescent signal of these three compounds, naphthalene dicarboxaldehyde (NDA) was substituted for OPA. Standard curves for PAH, HPA and DMB with either OPA or NDA were constructed. To deterand PGN. While standard curves have been developed for the aliphatic compounds PAH, HPA, and DMB.

Whole Cell Optimization

The effect of addition of lyophilized nitrilase lysate to the assay components, either untreated or heat inactivated, was evaluated. Interfering background fluorescence was not observed in either case. The OPA assay was next evaluated and optimized for nitrilase activity detection in a whole cell format. Both nitrilase expressing whole cells and in-situ lysed cells were evaluated. Lyophilized cell lysates were evaluated alongside their respective whole cell clones as controls. For this optimization study, mandelonitrile (MN) was chosen as a model substrate.

The lyophilized cell lysate of SEQ ID NOS:187, 188 was evaluated alongside whole cells expressing SEQ ID NOS: 187, 188 and in situ lysed cells expressing SEQ ID NOS:187, 188. The addition of whole cells did not affect fluorescence nor result in fluorescence quenching. Addition of any of the three cell lysis solutions improved permeability (and therefore conversion) of mandelonitrile in the whole cell systems. Three cell lysing solutions were evaluated: B-PER (Pierce), BugBuster (Novagen) and CelLytic B-II (Sigma) and were found not to have a deleterious affect on the OPA assay. The addition of product α-hydroxyacid or α-aminoacid did not affect detection by the OPA assay.

The assay was modified from its original format, which required several liquid transfer steps, into a one plate process, where cell growth, nitrile hydrolysis and OPA assay reaction occurred in the same microtiter plate. Mandelonitrile was tested using this single well format. In this case, the E. coli. Gene site-saturation mutagenesis (GSSM™) cell host was evaluated. Three clones were tested: SEQ ID NOS:101, 102, SEQ ID NOS:187, 188, and an empty vector, which was used as a control. Hydrolysis was evaluated at four timepoints, at 10 and 20 mM, and also with a 0 mM control. In an earlier experiment, clone SEQ ID NOS:187, 188 was evaluated against the phenylacetaldehyde cyanohydrin substrate (for which this enzyme does not exhibit activity), and no activity was observed.

The OPA assay was found to detect the presence of both α-hydroxy and α-amino nitrile substrate. Aromatic compounds were readily detectable with the assay, while aliphatic compounds posed some detection challenges. No background issues were evident when using lyophilized cell lysates, in-situ lysed whole cells or unlysed whole cells. The assay is amenable to one-plate analysis, where cells are grown, incubated with the substrate, and assayed on the same plate: no liquid transfers are required, easing automation. While all nitrites tested produced a linear response, aliphatic compounds gave a low fluorescent response.

Chiral LDH Assay

A spectroscopic system based on lactate dehydrogenase (L-LDH) was developed for the analysis of the chiral α-hydroxy acids which are generated by the nitrilase catalyzed hydrolysis of cyanohydrins. The hydroxynitrile substrate is not metabolized by the secondary or detection enzyme and thus starting material does not interfere. Cell lysate which is not heat treated results in background activity for the LDH system; however, heat inactivation or pelleting of the cell lysates eliminates the background activity. (See FIG. 4.)

The activity and enantiomeric specificity of commercially available D- and L-lactate dehydrogenases against the nitrilases disclosed herein was evaluated. An LDH was identified which is suitable to both D- and L-phenyl lactic acid analysis. An enzyme suitable for 2-Chloromandelic acid analysis was not found. The chosen LDH enzymes exhibited virtually absolute stereoselectivity. The viability of the assay to detect D- and L-LDH produced from PAC using lyophilized cell lysate was established.

Originally, three colorimetric dyes were evaluated, all of which are tetrazolium salts: NBT (3,3'-dimethoxy-4,4'-biphenylene)bis[2,(4-nitrophenyl)-5-phenyl-2H]-, chloride) MTT (3-(4,5-dimethylthiazol-2-yl)-2,5-diphenyltetrazolium bromide) INT (2-(4-Iodophenyl)-3-(4-nitrophenyl)-5-phenyl-2H-tetrazolium chloride). The insolubility of the product of these detection system posed an analytical challenge. To address this, another tetrazolium salt with a reportedly soluble product, XTT (2,3-Bis-(2-methoxy-4-nitro-5-sulfophenyl)-2H-tetrazolium-5-carboxanilide, was evaluated. While XTT yielded a soluble bright red product, the substrate was insoluble which thus effected the same analytical challenges. As an alternative to the tetrazolium family of dyes, the dual colorimetric/fluorometric dye resazurin was evaluated.

Oxidation of resazurin produces resourfin. Both substrate and product are soluble, and the color change can be quantified colorimetrically or fluorimetrically, increasing accuracy. Due to the sensitivity of resazurin, 0.05 mM of lactic acid can be quantified. Optimal results were obtained when using the dye in the same range as the substrate, e.g. 0.5 mM resazurin can quantify a range of lactic (and analogs) from 0.05 to 0.5, though the best linearity is at the lower end of this scale. Resourfin was stable over 28 hours, and had a linear fluorescent response.

In the presence of the LDH assay components, lyophilized enzyme gave background fluorescence/absorption. To address this problem the lysate was boiled for 10 minutes and then centrifuged. This resulted in a 90% decrease in background signal. Interestingly, both centrifugation alone (5 minutes@14.1 rcf) or boiling followed by centrifugation (5 minutes@100° C.) reduced the fluorescence to background levels. In a high-throughput format such as 1536 well plates, spinning would be preferable to boiling, as boiling would increase evaporation (8 µl well size) and potentially volatize the nitrile substrates. No background signal resulting from growth media (LB and TB and M9) or cell lytic solutions (B-PER, CelLytic and BugBuster) was noted.

Chiral AAO Assay

A spectroscopic system based on amino acid oxidase (AAO) was developed for the analysis of the chiral α-amino acids which are generated by the nitrilase catalyzed hydrolysis of amino nitrites.

Assay Development and Validation

The initial assay validation utilized the 2,2'-azino-di-{3-ethylbenzothiazoline-6-sulfonic acid (ABTS) detection system as outlined above. However, since the color was not stable further investigations utilized the phenol amino antipyrine (PAAP) detection system which is analyzed at λ max 510 nm. Enzymes with suitable activity were found for each enantiomer of 4-methyl-leucine, phenylalanine, (S)-2-amino-6-hydroxy hexanoic acid, and tert-leucine. The assay is not applicable to methylphenylglycine and does not work well with phenylglycine.

Standard curves were generated for phenylalanine from 0-15 mM. The curve is much more linear when the concentrations remained below 1 mM. The color remains stable for several days as long as it is kept in the dark. Three cell lysing solutions Bug Buster (BB), Bacterial Protein Extracting Reagent (BPER), and Cell Lytic Reagent (CLR) were added to the standard curve and shown to have no affect on color development. The addition of cell lysate (cl) did not exhibit background color formation. Addition of the phenylacetaldehyde aminonitrile sulfate (PAS) starting material also showed no effect on color formation.

The AAO system exhibits greater linearity at up to 1 mM substrate. The concentration of the AAO enzymes and of the acid substrate were adjusted to try to move the intersection of the L-AAO and D-AAO curves closer to the middle of the graph. Premixing the PAAP, the HRP, and the AAO was demonstrated to be effective and caused no change in observed activity establishing that the assay components may be added to the assay in a cocktail format.

A high level of background was observed for the AAO assay of whole cells and this was attributed to the L-amino acids present in the TB and LB growth media. Washing and resuspension of the cells in M9 media eliminated background. For all future experiments cells were grown in M9 media with 0.2% glucose. The lysed cells gave only a slightly better response that unlysed cells. Therefore, cell lysis is not necessary. SEQ ID NOS:187, 188 demonstrated activity on HPA in primary screening based on HPLC analysis.

The use of a fluorescent detection system which would permits implementation of the assay in ultra high throughput fashion such as 1536 well or gigamatrix format was investigated. The fluorescent reagent most applicable to our system is Amplex Red from Molecular Probes which produces the highly fluorescent resorufin ($\lambda_{ex}$ 545 nm; $\lambda_{em}$ 590 nm) Standard curves for phenylalanine and (S)-2-amino-6-hydroxy hexanoic acid were established (0-100 µM).

In preparation for assay automation, nitrilase expressing cells were added into microtiter plate containing M9 0.2% glucose, 0.25 mM IPTG media by florescence activated cell sorting (FACS). Three nitrilase expressing subclones, and the empty vector control were evaluated: SEQ ID NOS:101, 102, SEQ ID NOS:187, 188, SEQ ID NOS:29, 30 and the empty vector. The viability of the cells following cell sorting proved to be inconsistent. Thus colony picking is currently being evaluated as an alternative method to add cells into microtiter plates. The evaporative loss from an uncovered 1536-well microtiter plate is approximately 30% per day in the robot incubator (incubator conditions: 37° C. at 85% relative humidity (RH)). Incubation in the 95% RH incubator reduced evaporative loss to 1% per day.

The ability of the three subclones to grow in the presence of up to 3.5 mM of nitrile was established using HPA nitrile. Growth rates were only slightly retarded (less that 30%). Subclones grown in the presence of HPA were shown to express a nitrilase that catalyzes the formation of hydroxy norleucine (HNL) as established using the Amplex Red detection system. Only S was evaluated as the enzymes are S-selective. The reaction plate was read at 10 minute intervals, with 40 minutes showing the best linearity. While cell growth is significantly inhibited above 5 mM of HPA when the cells were grown at pH 7, growth was inhibited above 0.1 mM HPA for cells grown at pH 8.

In order to verify the AAO results by HPLC, a reaction was performed using high concentrations of HPA, up to 40 mM (due to HPLC detection challenges for (S)-2-amino-6-hydroxy hexanoic acid) and lyophilized cell lysate SEQ ID NOS:187, 188.

| Comparison AAO and HPLC data for HNL | | | | |
|---|---|---|---|---|
| [HNL] | % ee | | % conversion | |
| mM | AAO | HPLC | AAO | HPLC |
| 40 | 89% | 100% | 17% | 18% |
| 30 | 89% | 97% | 29% | 36% |
| 20 | 86% | 97% | 21% | 34% |
| 10 | 78% | 98% | 13% | 35% |

In order to determine if conducting the screen at a lower concentration introduces a bias in the results compared to the 20 mM substrate range that was used for HPLC based screens, an experiment was performed with SEQ ID NOS: 187, 188 using three concentration ranges. Each experiment was done in triplicate in order to remove any nonsystematic error.

The AAO assay can be run on 384 or 1536 well format with cells sorted into an M9 0.2% glucose, 0.25 mM IPTG media. Cells can be grown in the presence of nitrile (in this case HPA), or the cells can be allowed to reach a certain density and the nitrile can then be added. Though cell lytic reagents do not interfere with the assay, when HPA was assayed, addition of the lytic reagents was found to be unnecessary. Either pre- or post-nitrile addition, the mother plate will have to be split into daughter plates, which are then assayed for the respective L- and D-enantiomer content. Incubation times with the AAO/Amplex Red reagents can be adjusted so that the D- and L-plate are read at separate times.

Example 16

Identification, Development and Production of Robust, Novel Enzymes Targeted for a Series of High-Value Enantioselective Bioprocesses The invention provides for the development of nitrilases, through directed evolution, which provide significant technical and commercial advantages for the process manufacturing of the following chemical target:

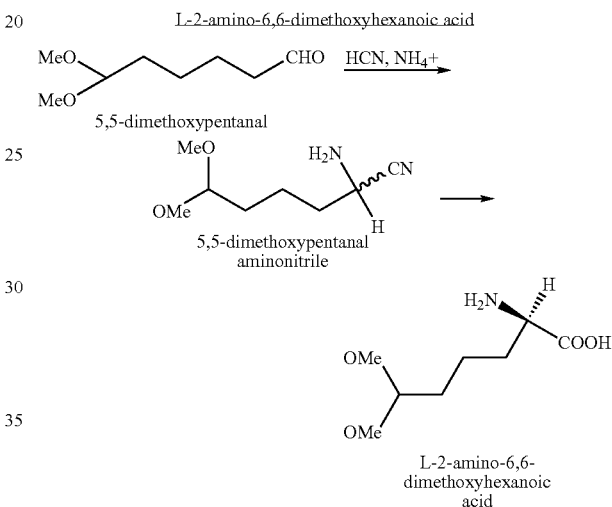

Nitrilase enzymes were shown to hydrolyze 2-amino-6-hydroxy hexanenitrile to (S)-2-amino-6-hydroxy hexanoic acid, with selectivity towards the L-enantiomer. The panel of nitrilases was screened against the target, 5,5-dimethoxypentanal aminonitrile. The positive enzymes were characterized on this substrate. A primary screen is used to identify putative up-mutants, which is then confirmed using HPLC.

GSSM™ and GeneReassembly™ are performed on selected nitrilases, in order to improve the enantioselectivity and activity of the enzymes for the production of L-2-amino-6,6-dimethoxyhexanoic acid. Nitrilases were identified for the enantioselective hydrolysis of 2-amino-6-hydroxy hexanenitrile to L-(S)-2-amino-6-hydroxy hexanoic acid. However, a slight structural difference is presented by the new target molecule, L-2-amino-6,6-dimethoxyhexanoic acid. In order to determine whether this difference affects the activity and enantioselectivity of the enzymes, the complete spectrum of nitrilases was screened against the new target.

First, identification of the correct target gene for GSSM through more detailed characterization of the hit enzymes for the production of L-2-amino-6,6-dimethoxyhexanoic acid was carried out. This effort involves a more extensive investigation of the effects of pH and temperature on activity and enantioselectivity and a more in-depth analysis of the stability of the enzyme to process conditions. Prior to initiation of the screening, the synthesis of a single enantiomer of an alkyl aminonitrile is done; the racemization of this nitrile is studied, in an effort to understand the relationship between this factor and enantioselectivity of the enzymes.

An enzyme exhibiting the highest combination of activity and enantioselectivity for the production of L-2-amino-6,6-dimethoxyhexanoic acid is selected for GSSM. Following the mutation of the target enzyme, the resulting mutants are screened on 5,5-dimethoxypentanal aminonitrile, using high throughput screening technology. Following confirmation of the up-mutants by HPLC analysis a decision point is reached, in order to evaluate the results of the GSSM on the target.

In parallel to GSSM™, a GeneReassembly™ is performed on a combination of parent enzymes, at least one of which is selected for activity and enantioselectivity on L-2-amino-6,6-dimethoxyhexanoic acid. At least two other nitrilases are reassembled with the former enzyme(s); these enzymes are selected in order to provide diversity to the reassembled sequences.

The present invention provides for development of racemization conditions for the original substrate aminonitriles. In addition, the present invention provides for the identification of enzymes capable of the conversion of these aminonitriles to the target α-amino acids by dynamic kinetic resolution. The present invention also provides for screening and development of a nitrilase-catalyzed kinetic resolution process for (R)-2-amino-6,6-dimethoxy hexanoic acid (allysine) production. (S)-2-amino-6-hydroxy hexanoic acid will be used as a model substrate for development of the kinetic resolution.

The Target α-Amino Acid Products are Shown Below:

(i) D-4-Fluorophenylglycine

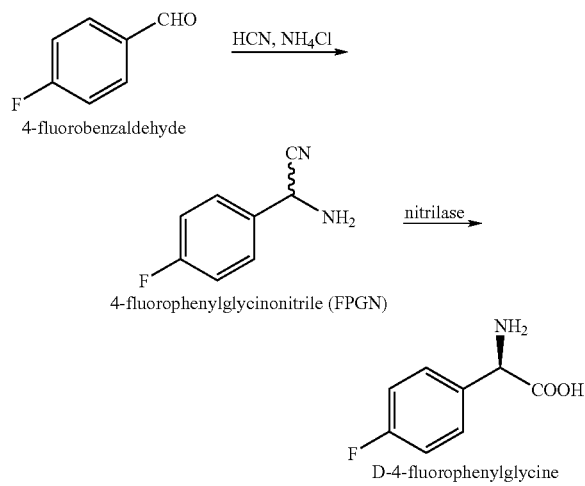

(ii) L-2-Amino-6,6-dimethoxyhexanoic acid (Allysine)

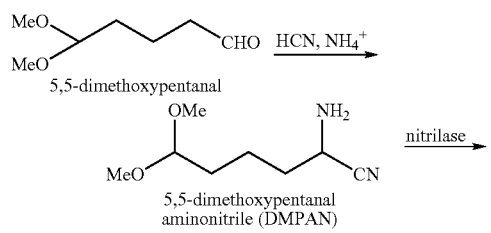

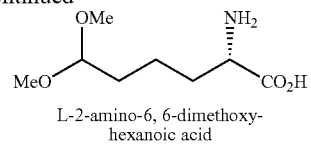

L-2-amino-6, 6-dimethoxy-hexanoic acid

Conditions are developed for the racemization of the aminonitrile substrates for the nitrilase-catalyzed production of D-4-fluorophenylglycine and 2-amino-4,4-dimethyl pentanenitrile (allysine). Two model substrates, phenylglycinonitrile and pentanal aminonitrile are used initially, and racemization is studied in the absence of the enzyme. Concurrently determination of the performance of one or more available nitrilases under a variety of possible racemization conditions is carried out. In addition, the nitrilases are screened against hydroxypentanal aminonitrile for the production of (S)-2-amino-6-hydroxy hexanoic acid, and the promising enzymes are optimized. Once racernization conditions are established, the nitrilases are screened for activity. Further optimization for a kinetic resolution of the product is performed.

A number of enantioselective nitrilases were identified for the hydrolysis of α-aminonitriles to α-amino acids. While these enzymes were shown to have a preference for the required enantiomer of certain aminonitriles, a limiting factor in the further screening, development and comparison of candidate nitrilases is the rate of racemization of the aminonitrile substrates under the reaction conditions.

Aromatic Aminonitrile Racemization

The first step is to establish conditions under which aromatic aminonitrile racemization occurs, using the model substrate, phenylglycinonitrile. Racemization strategies include, but are not limited to the list below. Options are roughly prioritized according to their commercial applicability.

(1) Manipulation of the pH of the reaction. Since it has been shown that racemization is rapid at high pH, this approach requires the discovery and optimization of nitrilases which are active and selective at pH>10.

(2) Addition of known chemical racemizing agents, such as aldehydes, ketones, weak bases, resins, metal ions, Lewis acids etc., which can enhance racemization at lower pH.

(3) Synthesis of N-acylated aminonitrile derivatives, e.g. N-acetyl phenylglycinonitrile, which may be more easily racemized. In the case of N-acetyl phenylglycinonitrile, a selective D-acylase which removes the acetyl group would enhance the optical purity of the nitrilase product.

(4) Use of a biphasic system in which base-catalyzed racemization occurs in the hydrophobic organic phase and enzymatic hydrolysis in the aqueous phase.

(5) Use of a 2-enzyme system comprised of a nitrilase and an aminonitrile racemase. One amino acid racemase is commercially available at present, and will be tested for activity against phenyl- and fluorophenylglycinonitrile. Gene libraries will be searched for genes showing homology to known amino acid amide racemases, hydantoin racemases or any other racemases which can be identified.

Once conditions for this racemization have been established, they provide the basis for development of conditions for racemization of the target aromatic substrate, 4-fluorophenylglycinonitrile (FPGN). The FPGN is expected to be less stable than the model substrate; thus, it may racemize more quickly, but degradation reactions may be faster as well. The ability of sample enzyme(s) to tolerate and/or function well under them is evaluated. Final optimization of screening methods include the target substrates, sample nitrilases, and substrate racemization conditions.

Investigations carried out have shown that phenylglycinonitrile is easily racemized at pH 10.8. However, it does not appear that any of the existing enzymes can tolerate such harsh conditions of pH. Samples from highly alkaline environments are screened for the presence of nitrilases which are tolerant to such conditions. Once discovered, the enzymes are sequenced and subcloned, and the enzymes are produced as lyophilized cell lysates ready for screening.

Aliphatic Aminonitrile Racemization

A model aliphatic aminonitrile, pentanal aminonitrile, is synthesized in its racemic form. However optically enriched samples are prepared using one the following approaches: (i) preparative chiral HPLC; (ii) diastereomeric salt resolution; (iii) diastereomeric derivatization or column chromatography; (iv) synthesis from L-N—BOC norleucine. An HPLC assay is used for the detection of these compounds.

HPLC Assay

An HPLC assay for the detection of the (S)-2-amino-6-hydroxy hexanoic acid is used. An assay involving pre-column derivatization is used.

Screening/Characterization:

Nitrilases are screened against 2-amino-6-hydroxy hexanenitrile. For enzymes capable of performing well at greater than 25 mM substrate, scale up reactions are performed. The substrate/product tolerance and stability profiles of the other enzymes are investigated.

The nitrilases are screened, and hits are characterized, focusing on pH and temperature optimum, enantioselectivity and stability under the reaction conditions.

Enzyme Evolution

A target enzyme exhibiting the desired properties is selected for GSSM™. Following the mutation of the target enzyme, the resulting mutants are screened on the substrate using high throughput screening technology. Once the up-mutants have been confirmed by HPLC analysis, the individual mutations responsible for increased performance may be combined and evaluated for possible additive or synergistic effects.

In addition, a GeneReassembly™ will be performed on a combination of lead enzymes, which are selected for their desirable characteristics, including activity, enantioselectivity and stability in the reaction.

Example 17

Optimization of Nitrilases for the Enantioselective Production of (S)-Phenyllactic Acid Nitrilases were identified for the enantioselective hydrolysis of 5 different nitrile substrates. These nitrilases were isolated and optimized for selected targets. The optimization involves process optimization and directed evolution. In particular, enzymes specific for the production of (S)-phenyllacetic acid were characterized and optimized. This was aimed primarily at improving the activity of the enzymes, while maintaining a high enantioselectivity. An investigation into the effects of process conditions on the enzymes was also performed.

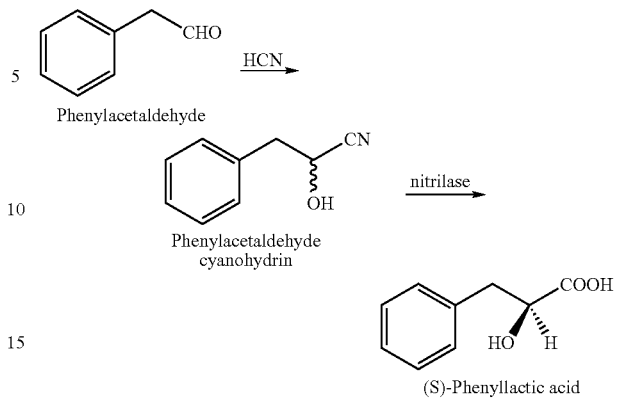

The development of high throughput assays for screening of mutants from potential directed evolution efforts was accomplished. Two achiral and two chiral colorimetric assays that are amenable to high throughput screening were developed and used for nitrilase directed evolution.

SEQ ID NOS:103, 104 was identified as a highly enantioselective nitrilase for the production of (S)-phenyllacetic acid. Characterization of SEQ ID NOS:103, 104 shows the optimum reaction pH and temperature to be pH 8 and 37° C., respectively; the reaction starting material, phenylacetaldehyde, and the product, phenyllacetic acid showed no effect on the enzyme activity up to levels of 5 mM and 30 mM, respectively. The scaled-up enzymatic reaction with an enantiomeric excess (ee) of 95%.

Example 18

Directed Evolution of a Nucleic Acid Encoding a Nitrilase Enzyme

The nitB gene (GenBank Accession No. AX025996, from *Alcaligenes faecalis*) was subjected to Gene Site Saturated Mutagenesis™ or GSSM™ to generate a library of single amino acid substitution mutants covering the entire enzyme. The sequence of the "parental" nitB gene used in the directed evolution is SEQ ID NO: 103, 104. A nitB mutant library was generated from carrying out GSSM™. This nitB mutant library was then screened for clones with increased whole cell hydroxymethylthiobutryonitrile (HMTBN, which is a nitrilase substrate) activity. The product of the nitrilase reaction on that substrate is hydroxymethylthiobutyric acid (HMTBA).

Assays were run at 35° C. with 100 mM HMTBN and 100 mM $K_3PO_4$, pH 7 to approximately 30-40% conversion. Two methods were used to quantitate HMTBN conversion, one being direct measurement of HMTBS produced by HPLC analysis and the other being indirect detection of residual HMTBN using the fluorescent cyanide assay, which has previously been described.

Putative nitB up mutants were subjected to a secondary assay to confirm the increased activity. In the secondary assay, up mutants and the wild type control were induced in expression medium in shake flasks. Shake flask cultures are then washed with 100 mM $K_3PO_4$, pH7 and resuspended to the same optical density at 660 nm. Kinetic assays were then performed with the normalized cell resuspensions under the same conditions used in the initial assays. Putative up mutants confirmed to have increased HMTBN activity were sequenced and tested for increased activity after transformation back into the same expression strain to ensure that increases in activity are not due to host mutations.

A confirmed nitB GSSM™ up-mutant is nitB G46P, which contains a glycine (GGT) to proline (CCG) substitution at amino acid 46. The whole cell HMTBN activity of this mutant is approximately 50% greater than that of wild type NitB at both 25° C. and 35° C. Upon identification of the beneficial G46P mutation, GSSM™ was used again to generate a pool of double mutants using the nitB G46P template. These mutants all contain the G46P mutation and an additional single amino acid substitution at a random site. The double mutants were assayed for HMTBN activity greater than that of nitB G46P. Double, triple and quadruple mutants were created in order to speed up the mutation process and identify beneficial mutations more quickly. After the first few beneficial mutations were identified and isolated, they were combined to generate double mutants, the best of which was DM18. DM18 was used as a template to generate triple mutants. The most active triple mutant was TM3 and that was used as a template to generate quadruple mutants. The most active quadruple mutant was QM2. The table summarizes these mutations.

| mutant | mutation 1 | mutation 2 | mutation 3 | mutation 4 |
|---|---|---|---|---|
| DM18 | R (gcg) 29 C(tgt) | Y(tac) 207 M (atg) | | |
| TM3 | R (gcg) 29 C(tgt) | Y(tac) 207 M (atg) | L(ctt) 170 T(act) | |
| QM2 | R (gcg) 29 C(tgt) | Y(tac) 207 M (atg) | L(ctt) 170 T(act) | A(gcg) 197 N9(aat) |

The mutants were characterized first by studying their whole cell HMTBN activity. At 100 mM HMTBN, the HMTBS production rate of QM2 is 1.2 times greater than that of the parental gene. However, at 200 mM HMTBN, the rate of QM2 is 3.6 times that of the parental gene. The productivity of these mutants is increased considerably when the HMTBN concentration is raised from 100 mM to 300 mM. As to conversion rates, TM3 completely converted the substrate after 270 minutes and both DM18 and SM show greater than 75% conversion after this time. To further address the issue of HMTBN concentration effects on activity/productivity of NitB, several mutants were assayed at both 400 mM and 528 mM HMTBN. NitB is essentially inactive at these substrate concentrations, however the mutants retain significant activity at these concentrations. In particular, the activity at these high concentrations were essentially the same as their activity at 200 mM substrate. Therefore, the mutants can be used over a wide substrate concentration range and provide much more flexibility in utility than the NitB parental gene.

The mutants were shown to have higher expression levels than the parental gene and it also appeared that the QM2 and TM3 mutants contained a greater proportion of soluble enzyme than the wild type as seen in SDS-PAGE analysis. As to stability, all of the enzymes showed essentially the same stability pattern at both 25° C. and 35° C.

Finally, the mutants were subjected to codon-optimization. The approach was to optimize the codons and therefore increase the expression levels in the particular host cell. That would, in turn, increase the activity per cell of the enzyme. This resulted in increased whole cell activity in the codon-optimized mutants as compared to controls. The increase in activity was approximately double the activity. An E. coli expression system was used.

Example 19

Selected Examples of Compounds Produced from a Nitrilase-Catalyzed Reaction

Figure 15:
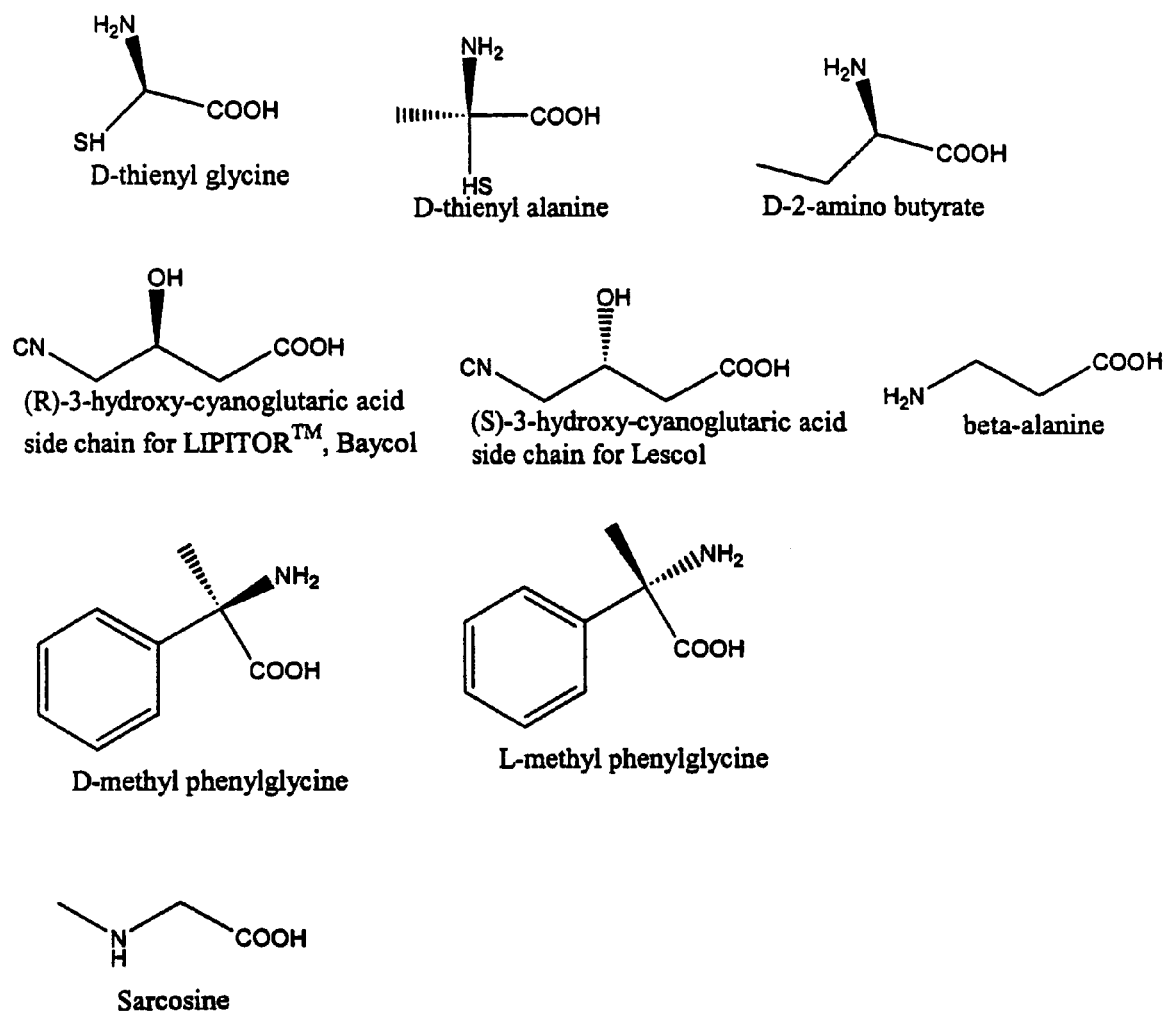
FIG. 15 illustrates selected compounds that can be produced from a nitrilase-catalyzed reaction using an enzyme and/or a method of the invention.
Figure 15:
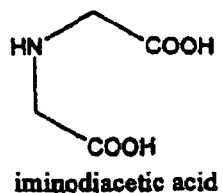
Figure 15:
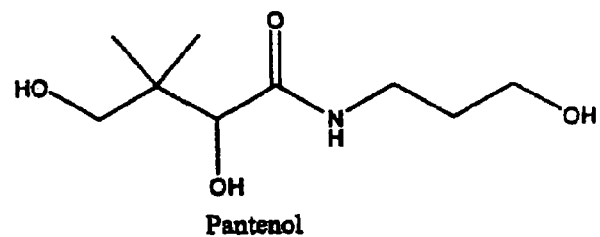
Figure 15:
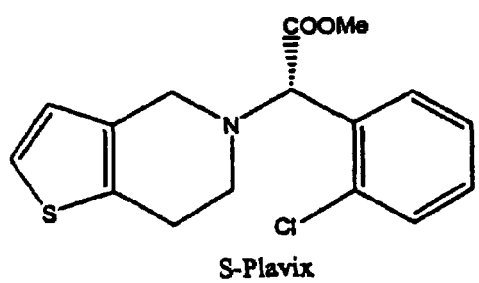
Figure 15:
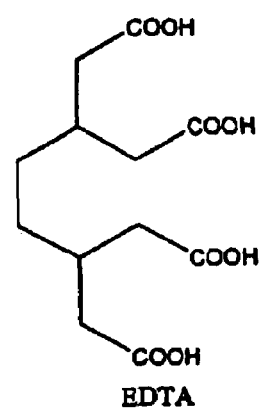
Figure 15:
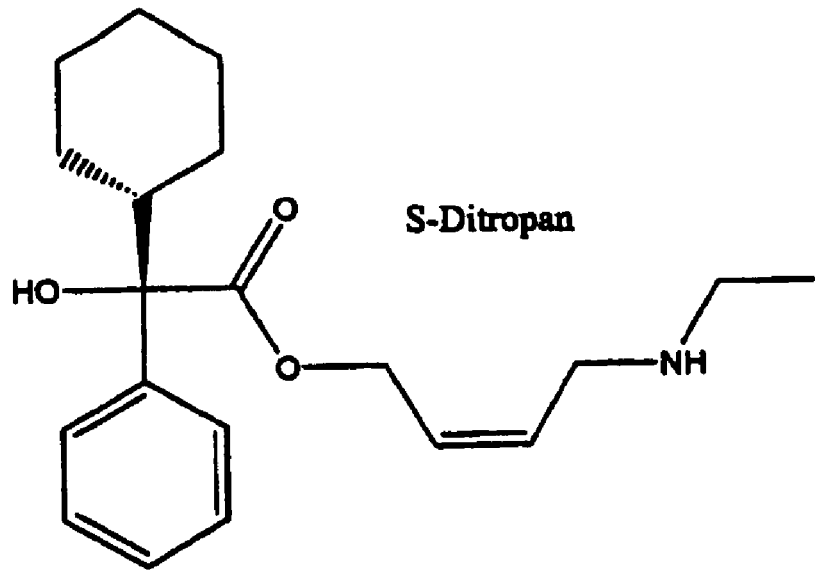
Figure 15:
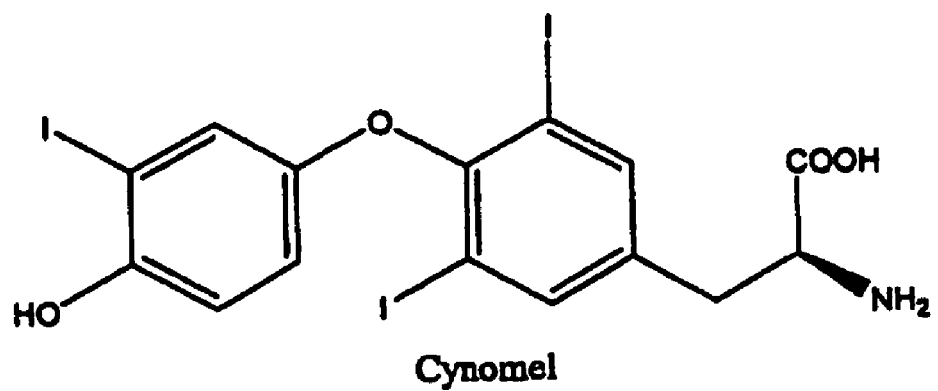
Figure 15:
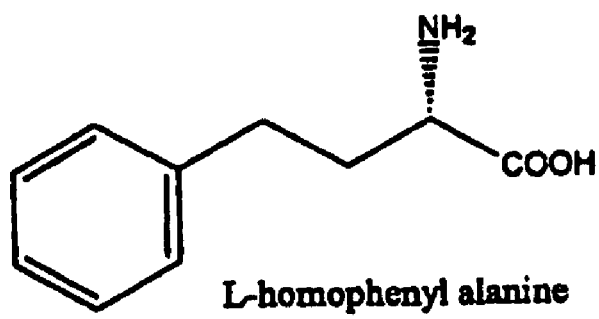
Figure 15:
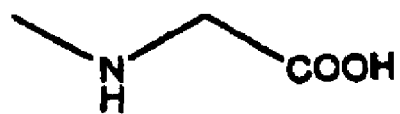
Figure 15:
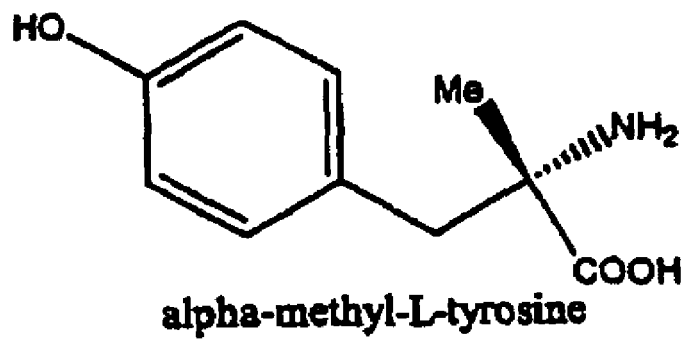
Figure 15:
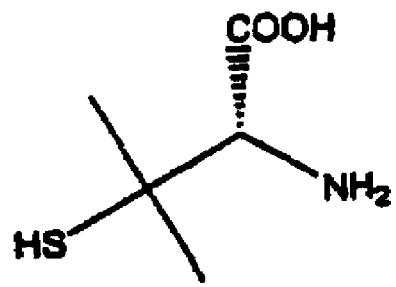
Figure 15:
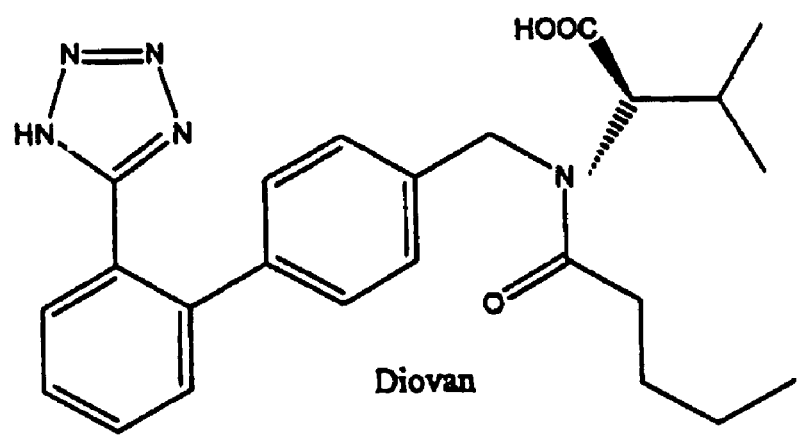
Figure 15:
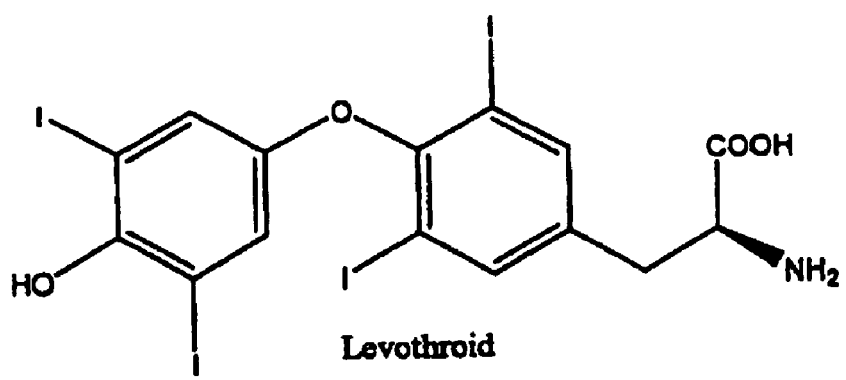
Figure 15:
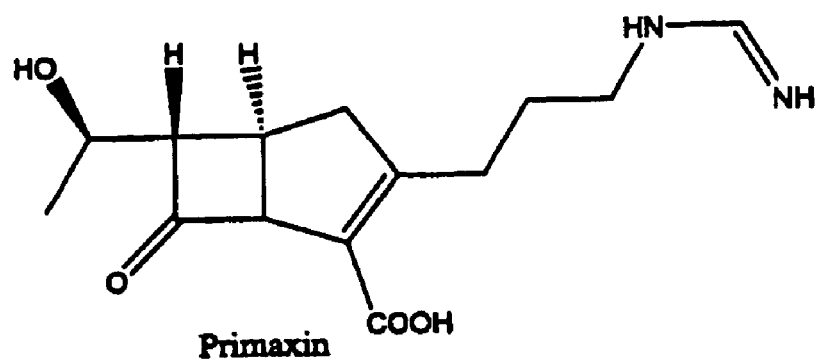
Figure 15:
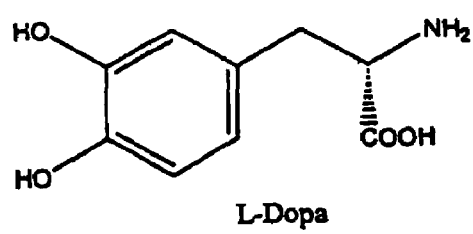
Figure 15:
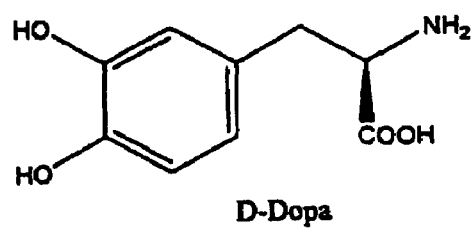
Figure 15:
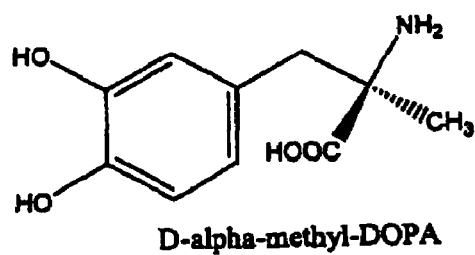
Figure 15:
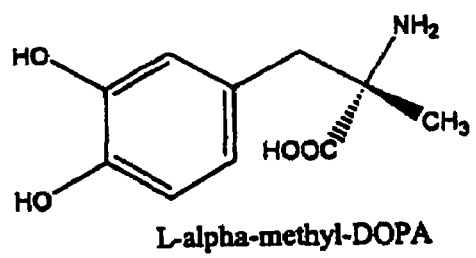
Figure 15:
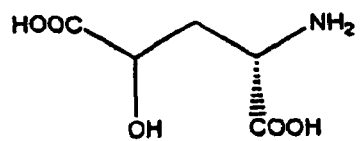
Figure 15:
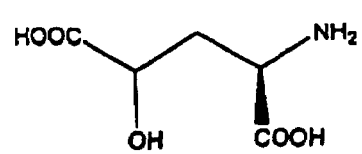
Figure 15:
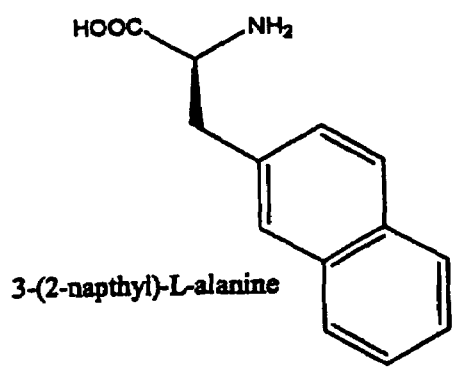
Figure 15:
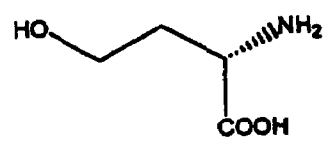
Figure 15:
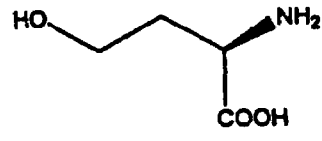
Figure 15:
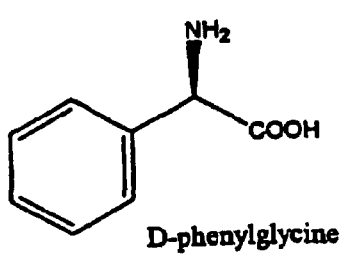
Figure 15:
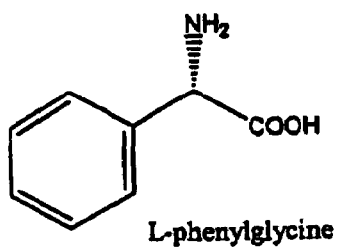
Figure 15:
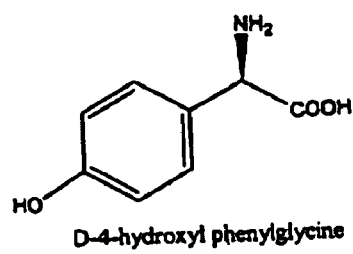
Figure 15:
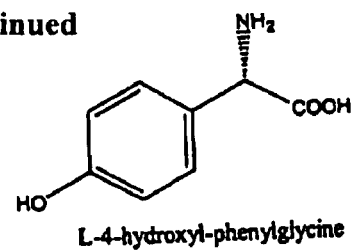
Figure 15:
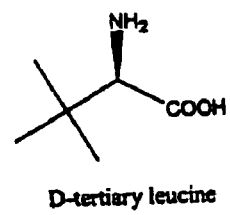
Figure 15:
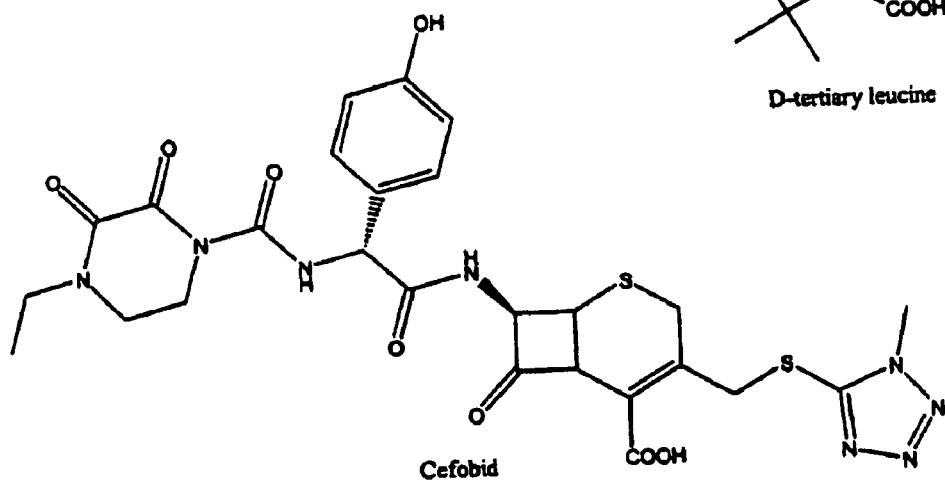
Figure 15:
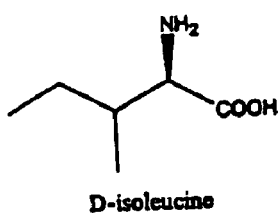
Figure 15:
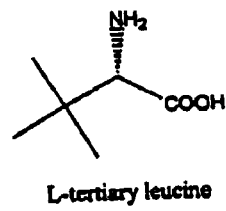
Figure 15:
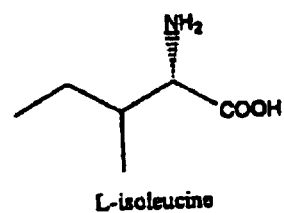
Figure 15:
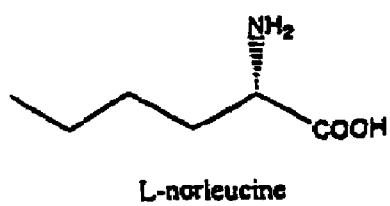
Figure 15:
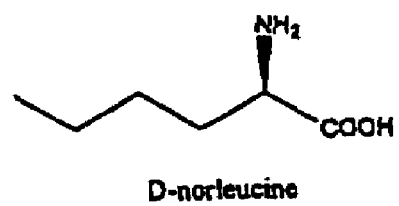
Figure 15:
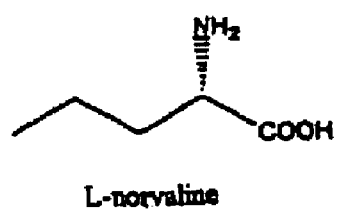
Figure 15:
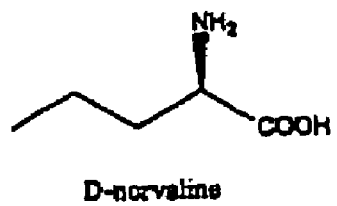
Figure 15:
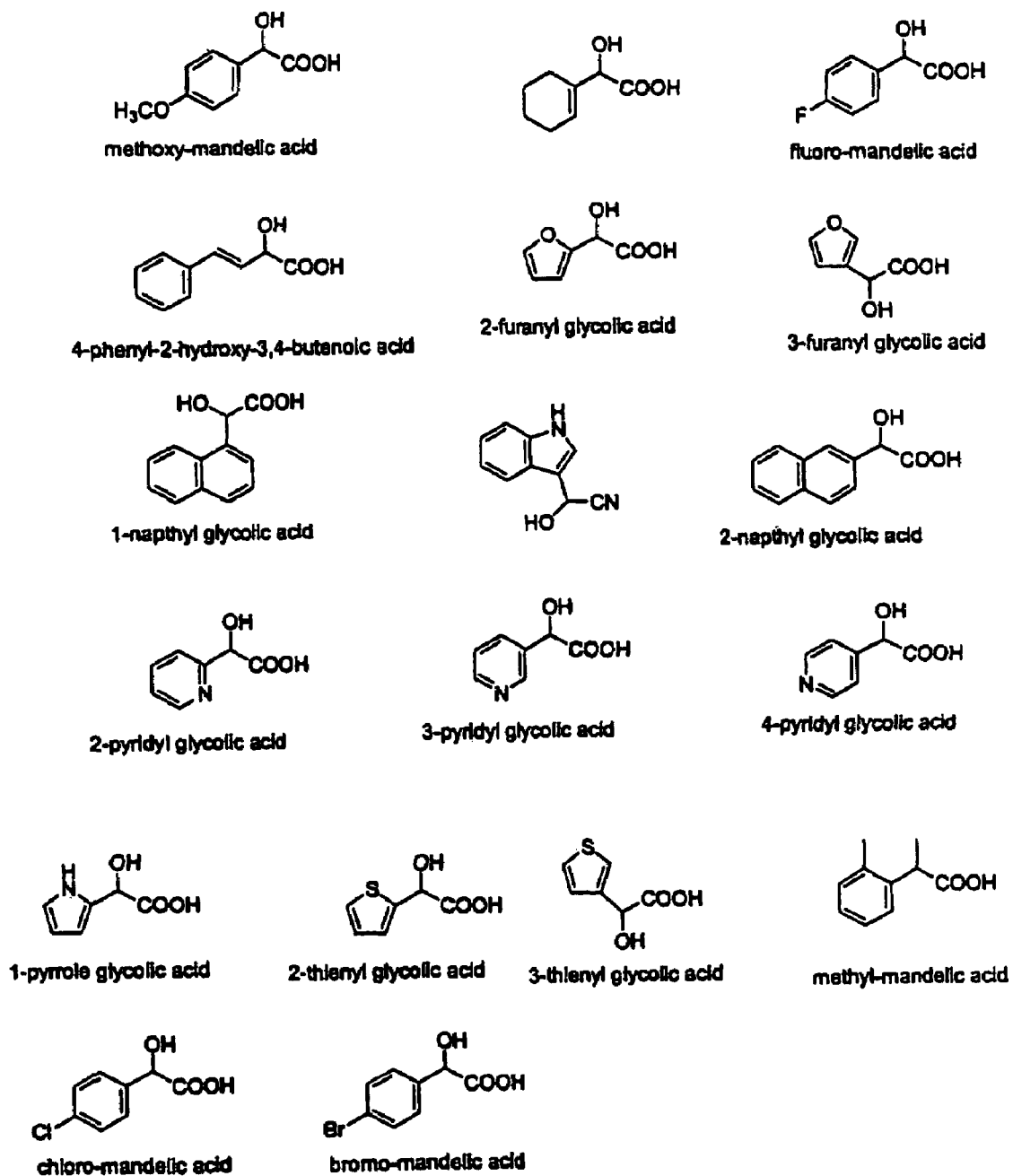
Figure 15:
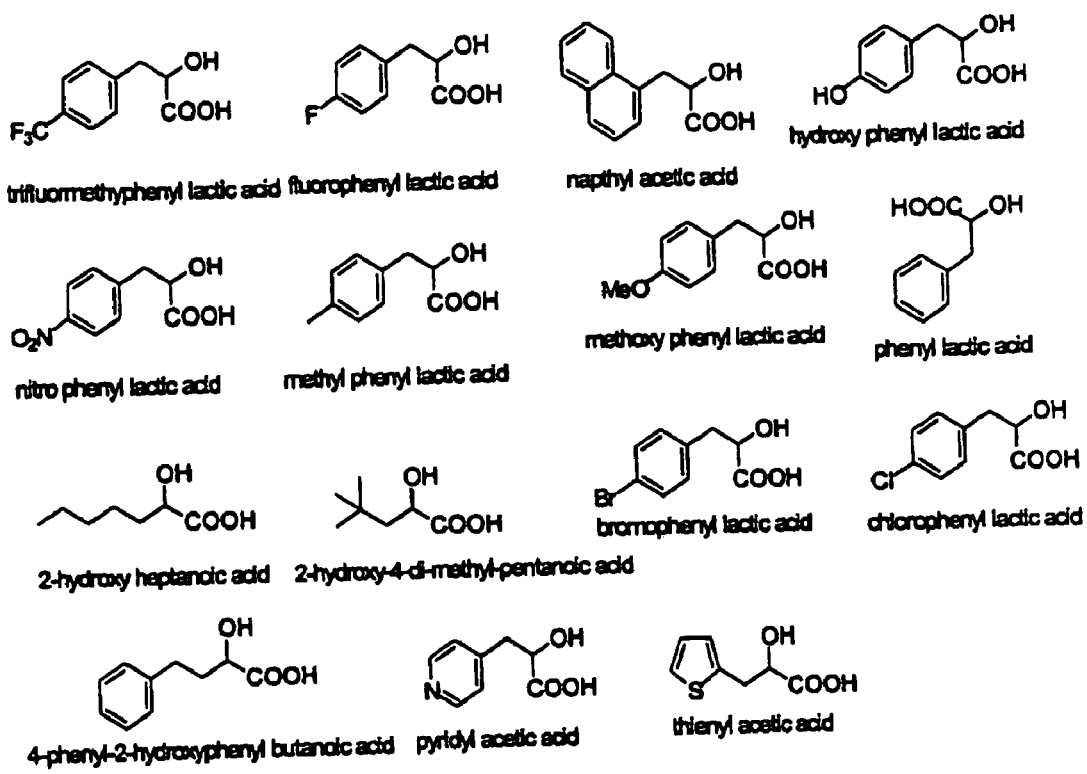
Figure 15:
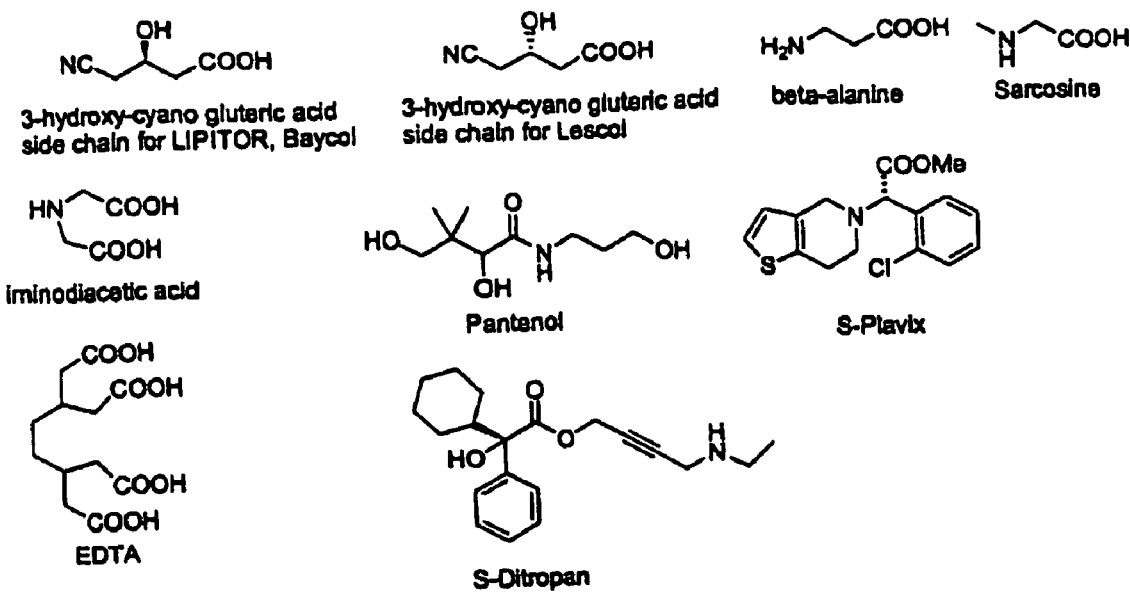
Figure 15:
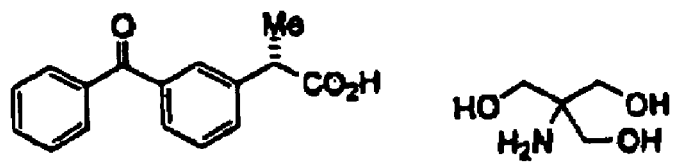
Figure 15:
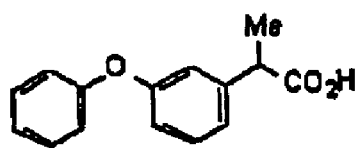
Figure 15:
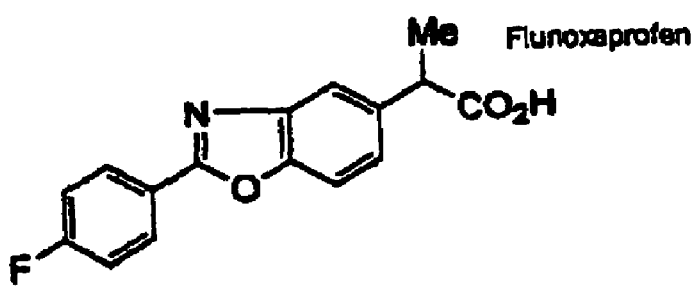
Figure 15:
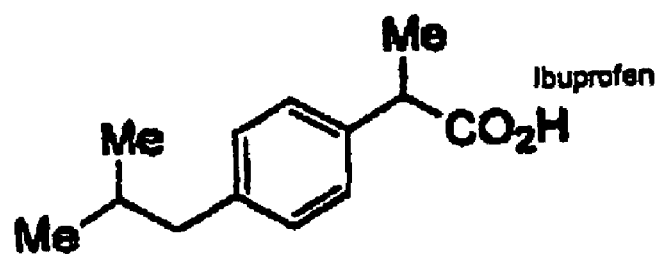
Figure 15:
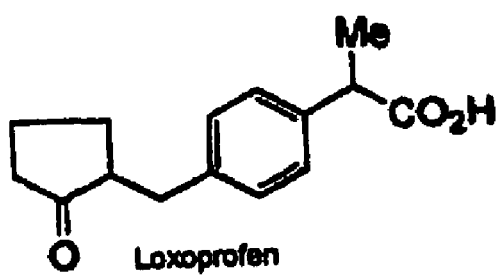
Figure 15:
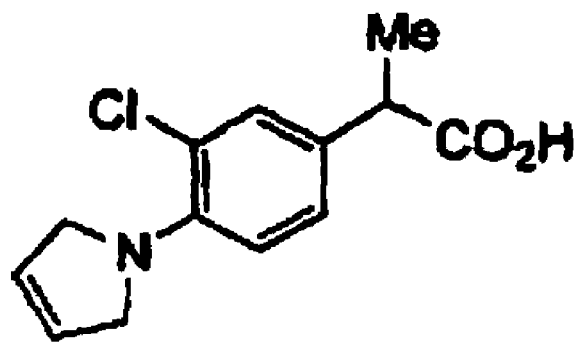
Figure 15:
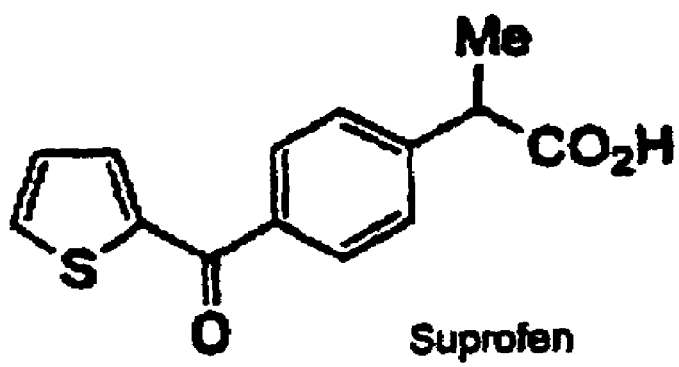
Figure 15:
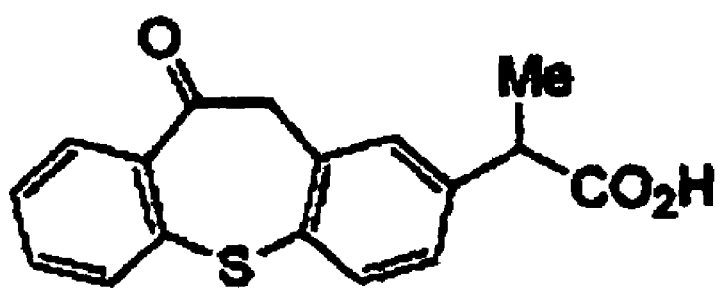
Figure 15:
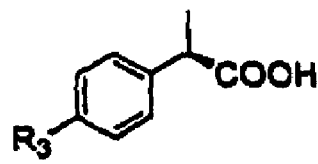
Figure 15:
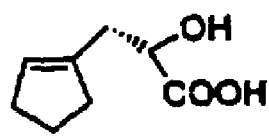
Figure 15:
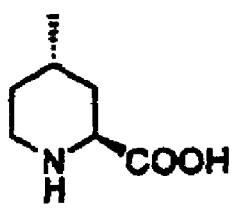
Figure 15:
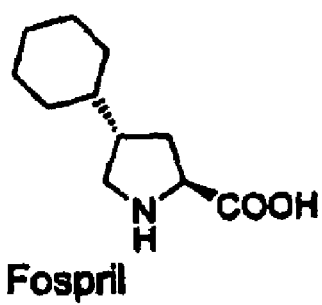
Figure 15:
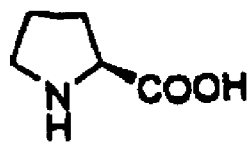
Figure 15:
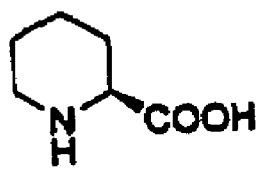
Figure 15:
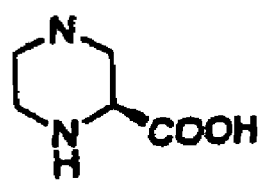

The compounds listed in FIG. 15 are selected compounds that can be produced from a nitrilase-catalyzed reaction using an enzyme and/or a method of the invention.

In addition, the following are potential products which can be made via the nitrilase Strecker format. More than 100 amino acids and many new drugs can be produced from their respective aldehydes or ketones utilizing the nitrilase enzymes of the invention. For example, large market drugs which can be synthesized using nitrilases of the invention include homophenylalanine, VASOTEC™, VASOTERIC™, TECZEM™, PRINIVIL™, PRINZIDE™, ZESTRIL™, ZESTORETIC™, RAMACE™, TARKA™, MAVIK™, TRANDOAPRIL™, TRANDOLAPRILAT™, ALTACE™, ODRIK™, UNIRETIC™, LOTENSIN™, LOTREL™, CAPOTEN™, MONOPRIL™, TANATRIL™, ACECOL™, LONGES™, SPIRAPRIL™, QUINAPRIL™, and CILAZAPRIL™. Other chiral drugs include DEMSER™ (alpha-methyl-L-Tyrosine), ALDOCHLOR™, LEVO-THROID™, SYNTHROID™, CYTOMEL™, THY-OLAR™, HYCODAN™, CUPRIMINE™, DEPEN™, PRI-MAXIN™, MIGRANOL™, D.H.E.-45, DIOVAN™, CEFOBID™, L-DOPA, D-DOPA, D-alpha-methyl-DOPA, L-alpha-methyl-DOPA, L-gamma-hydroxyglutamate, D-gamma-hydroxyglutamate, 3-(2-naphthyl)-L-alanine, D-homoserine, and L-homoserine.

Furthermore, the nitrilase enzymes of the invention can be useful for synthesizing the following amino acids. Many of these amino acids have pharmaceutical applications. D-phenylglycine, L-phenylglycine, D-hydroxyphenylglycine, L-hydroxyphenylglycine, L-tertiary leucine, D-tertiary leucine, D-isoleucine, L-isoleucine, D-norleucine, L-norleucine, D-norvaline, L-norvaline, D-2-thienylglycine, L-2-thienylglycine, L-2-aminobutyrate, D-2-aminobutyrate, D-cycloleucine, L-cycloleucine, D-2-methylphenylglycine, L-2-methylphenylglycine, L-thienylalanine, and D-thienylalanine.

The enzymes of the nitrilase enzymes of the invention can be useful for the synthesis of the following natural amino acids: glycine, L-alanine, L-valine, L-leucine, L-isoleucine, L-phenylalanine, L-tyrosine, L-tryptophan, L-cysteine, L-methionine, L-serine, D-serine, L-threonine, L-lysine, L-arginine, L-histidine, L-aspartate, L-glutamate, L-asparagine, L-glutamine, and L-proline. The following are examples of unnatural amino acids which can be produced using the nitrilase enzymes of the invention. D-alanine, D-valine, D-leucine, D-isoleucine, D-phenylalanine, D-tyrosine, D-tryptophan, D-cysteine, D-methionine, D-threonine, D-lysine, D-arginine, D-histidine, D-aspartate, D-glutamate, D-asparagine, D-glutamine, and D-proline.

Furthermore, nitrilase enzymes of the invention can be used in non-Strecker chemical reactions including the synthesis of more chiral drugs such as TAXOTERE™ as well as chiral drugs containing 3-hydroxy-glutaronitrile (a $5.5 B market); LIPITOR™, BAYCOL™, and LESCOL™. Chiral product targets that are not drugs include PANTENOL™, L-phosphinothricin, D-phosphinothricin, D-fluorophenylalanine, and L-fluorophenylalanine. Finally, nitrilase can be used to produce unnatural amino acid compounds lacking a chiral center such as sarcosine, iminodiacetic acid, EDTA, alpha-aminobutyrate, and beta-alanine.

Figure 16:
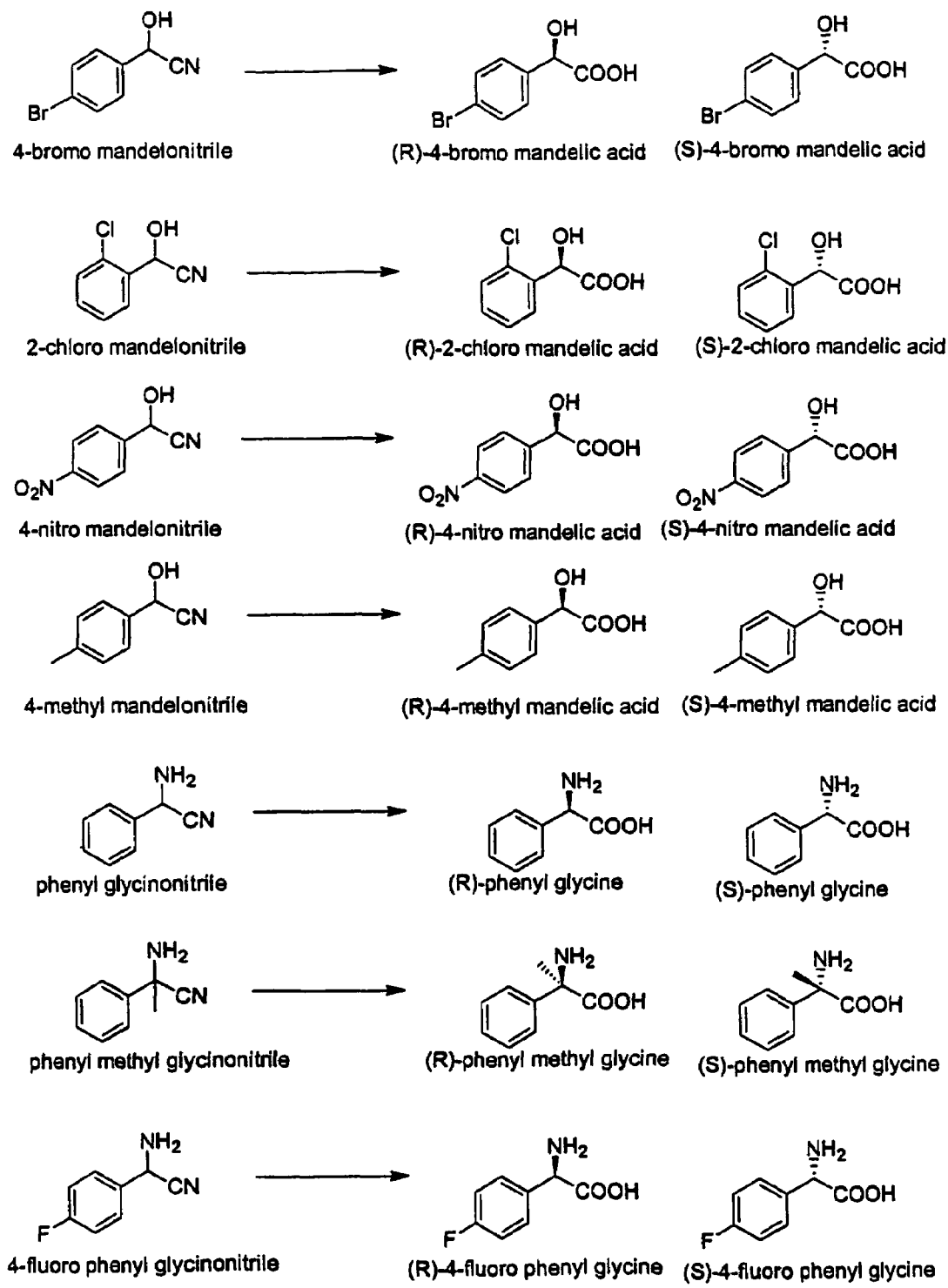
FIG. 16 illustrates selected compounds that can be produced from a nitrilase-catalyzed reaction using an enzyme and/or a method of the invention.
Figure 16:
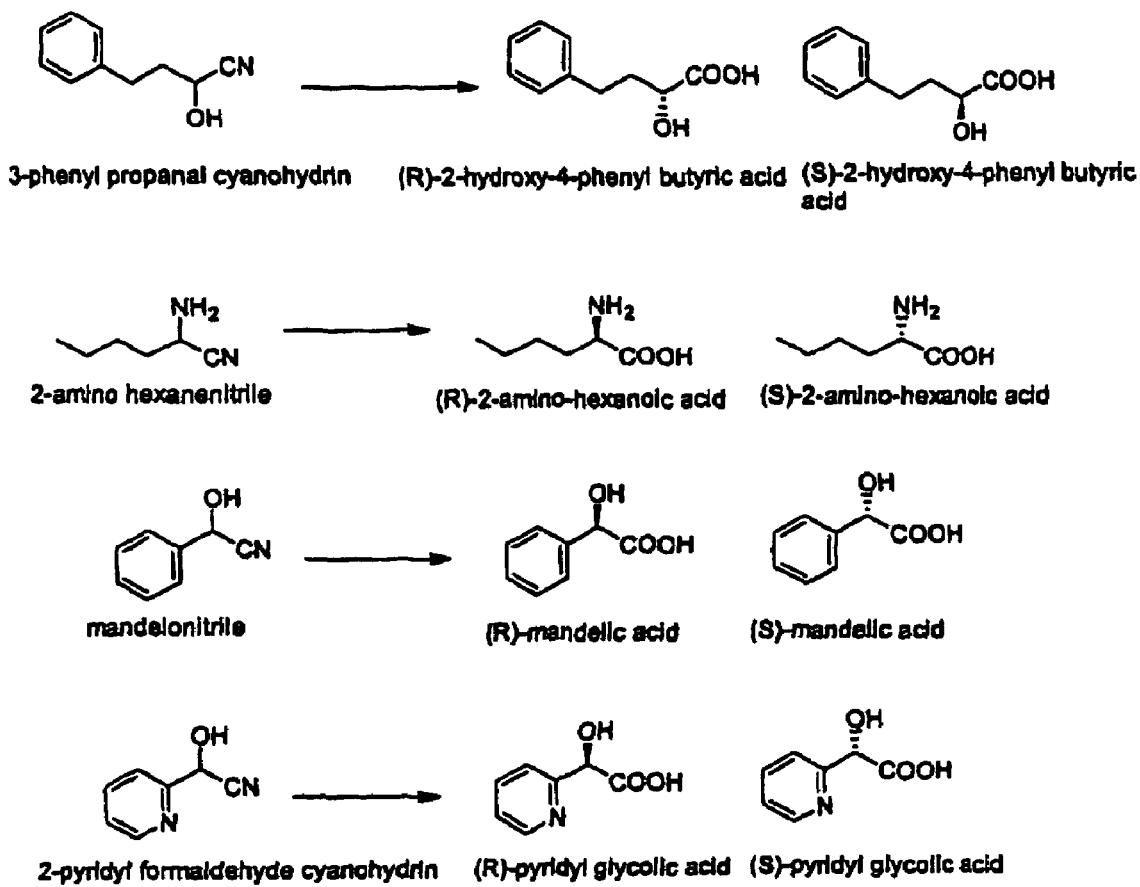
Figure 16:
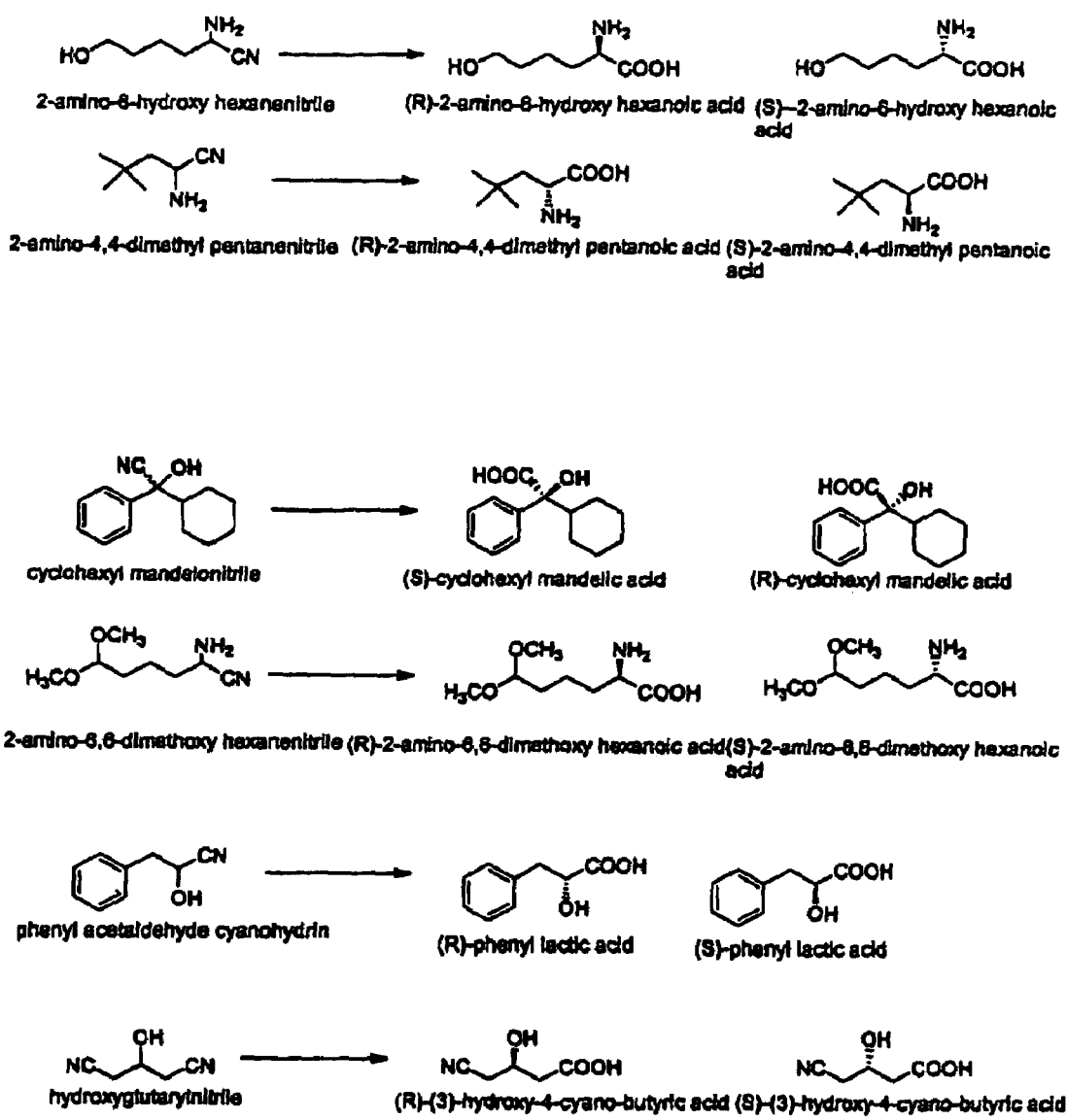
Figure 16:
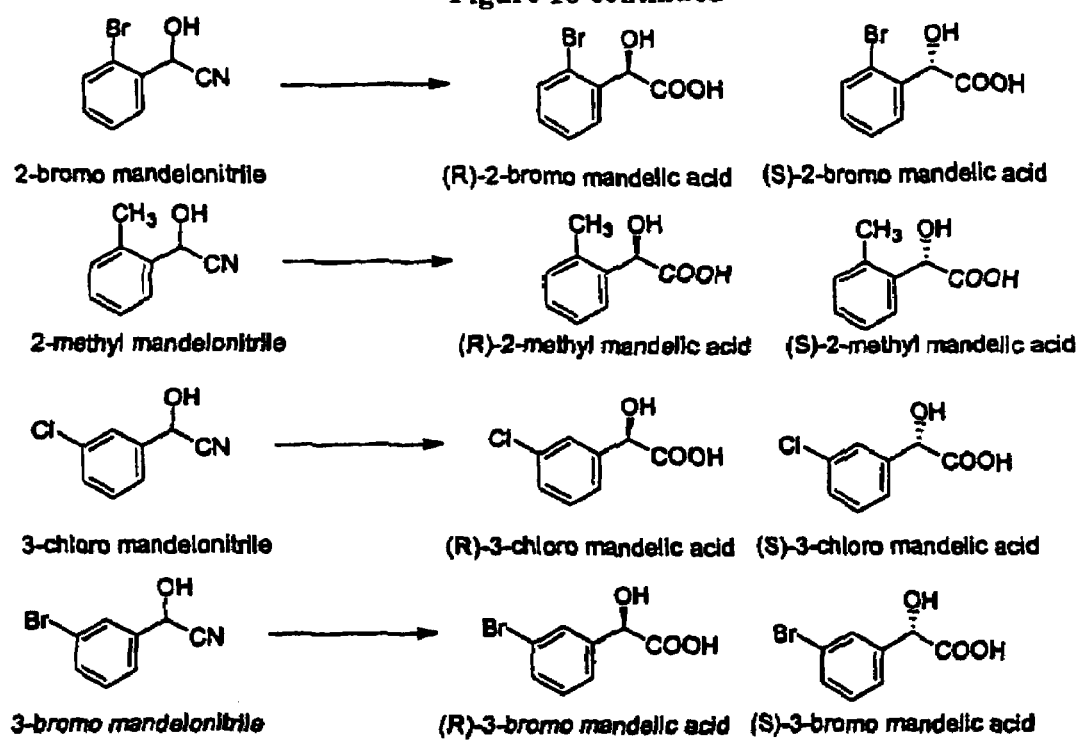
Figure 16:
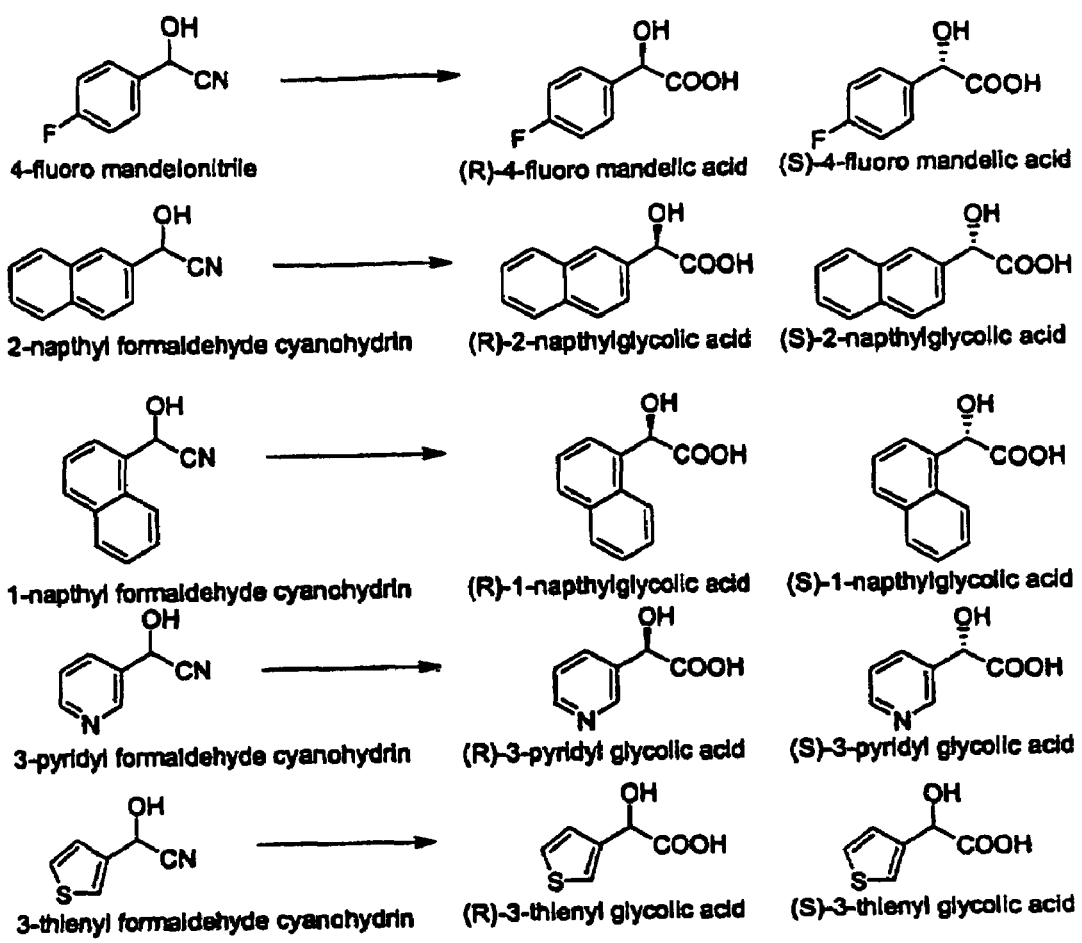
Figure 16:
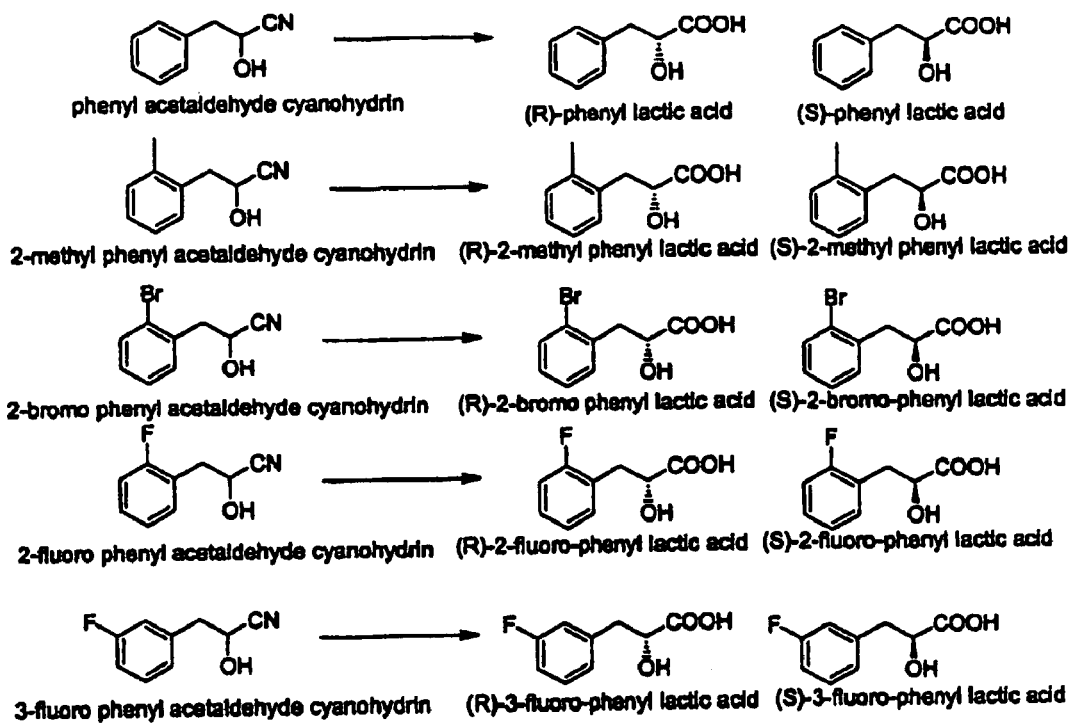
Figure 16:
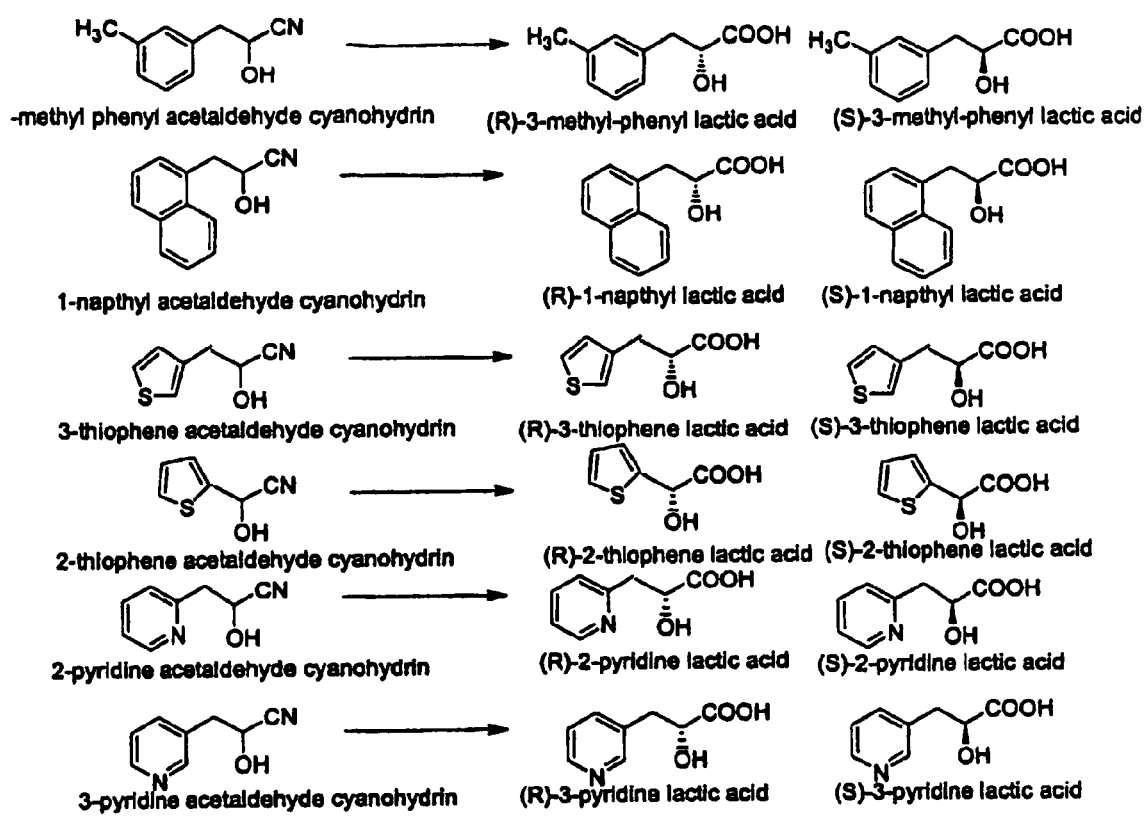

FIG. 16 examples of substrates and products produced by the nitrilases of the invention and/or the methods of the invention. The chemical structures of the substrates and of the products are shown. The chemical reactions shown here are non-limiting examples of activities of the nitrilases of the invention.

Example 20

Exemplary Preparation Using a Polypeptide of a Variant of SEQ ID NO:210

The variant, nitrilase 1506-83-H7A, is SEQ ID NO:210 with the Ala at residue 190 replaced with His. At the codon level, the mutation that occurred was GCT to CAT. This variant exhibits improved enantioselectivity in the conversion of 3-hydroxyglutarylnitrile (HGN) to (R)-4-Cyano-3-hydroxybutyrate.

This variant has been demonstrated to perform this transformation in 100 mM pH 7 sodium phosphate buffer at room temperature. This mutant can perform in other buffer systems and temperatures as well with the potential for providing additional altered properties. Exemplary properties include, but are not limited to, altered rates of the reaction, % ee, and stability. In particular, the altered properties can be a higher reaction rate, a higher % ee, and greater stability. Altered properties can be an increase or decrease of at least 25%, 30%, 35%, 40%, 45%, 50%, 55%, 60%, 65%, 70%, 75%, 80%, 85%, 90%, or 95% more than wildtype.

This variant was shown to perform the transformation by producing products in high enantiomeric excess of 10 mM to 3 M substrate (HGN). Higher or lower substrate concentrations are also possible. Enantiomeric excess greater than or equal to 95% have been achieved. However, enantiomeric excess can be at least 25%, 30%, 35%, 40%, 45%, 50%, 55%, 60%, 65%, 70%, 75%, 80%, 85%, or 90% more than wildtype.

Variants of the SEQ ID NOs: of the invention, can be cloned into expression vectors. For example, variants of nucleic acid sequence SEQ ID NO:195, 205, 207, 209, OR 237, and nucleotides that encode the variants of amino acid sequence SEQ ID NO:210 can be cloned into exemplary vectors that include, but are not limited to, pSE420 (*E. coli* expression vector) and pMYC (pseudomonas expression vector).

Example 21

Preparation Using Variants of the Invention

Add 3-Hydroxyglutaronitrile (1 g, 9 mmol) drop-wise to a stirred solution of nitrilase cell lysate (normalized for 150 mg protein content) in 2.12 mL of 100 mM pH 7 sodium phosphate buffer at room temperature, ~22° C. Stir this 3 M reaction by magnetic stir bar for 24 hours at room temperature. Monitor the progress of the reaction by TLC (Thin Layer Chromatography) and GC (Gas Chromatography). The reaction should be complete within 24 hours.

Other variants contemplated herein include, but are not limited to the following: N111S; A190H, S, Y or T; F191L, V, M, D, G, E, Y or T; M199E, or L; D222L; A55K, G, or Q; I60E, or any combination thereof.

Example 22

Screening Assay for Enantioselective Transformation

A new method to screen for enantioselective transformation, for example, of a prochiral substrate into a chiral one that affords the ability to monitor enantiomeric excess (% ee) of the resultant product is disclosed. This approach can also be applied to determine diasteromeric excess (% de).

For example, by labeling one of the two prochiral or enantiotopic moieties in a molecule, for example by the use of a heavier or liter isotope, the modification of one of the two moieties by a selective catalyst, for example, an enzyme, can be established by mass spectroscopy (MS).

Figure 17:
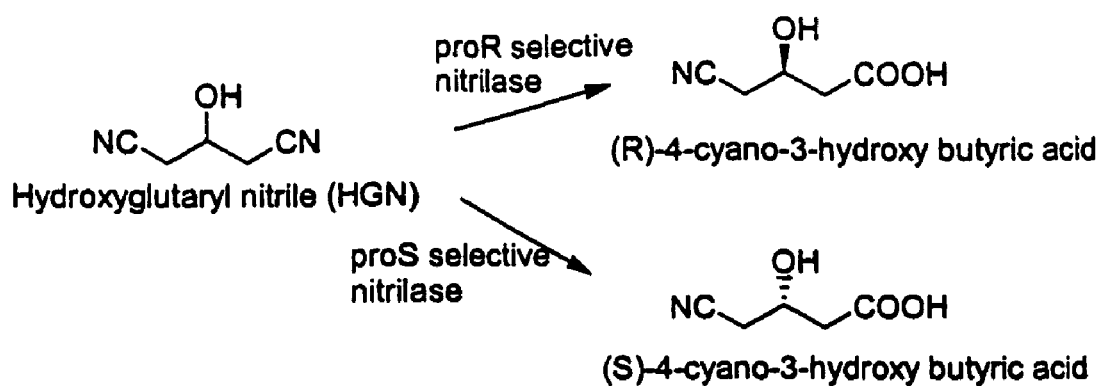
FIG. 17 illustrates an exemplary nitrilase reaction of the invention.

By performing the exemplary nitrilase reaction on $^{15}$N—(R)—HGN(R) (as shown in FIG. 17) or $^{15}$N—(S)—HGN, one can determine the enantioselectivity of the enzyme by analyzing the amount of each of the two possible labeled versus unlabeled acid products which can be formed.

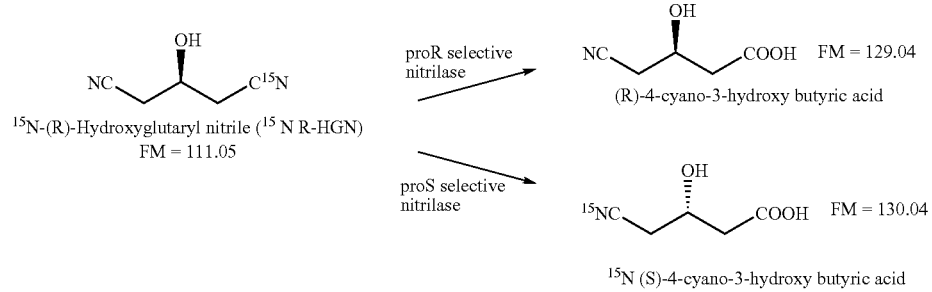

The screening experiment may be performed in either direction. The screening experiment can be used for both the 15N—(R)— and (S)—HGN moieties. In fact, to ensure that the label does not effect any artifactual changes, at the onset, both should be investigated.

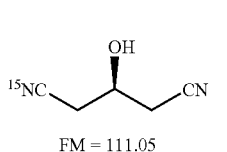
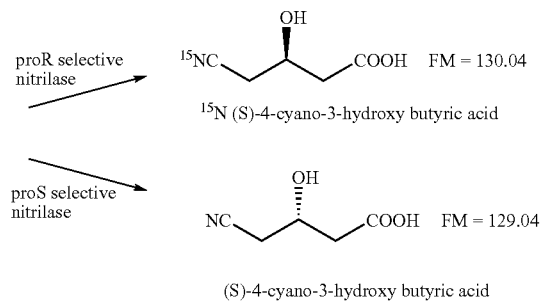

To equate the observed enantiomeric excess resulting from the nitrilase transformation, the following exemplary formula may be applied:

% ee={[130]−[129]}/{[130]+[129]}, where each concentration of the light acid (129) and the heavy acid (130) are determined by correlation of the peak area on the mass spectrometer to a standard curve or by direct comparison of the areas of each of the 129 and 130 mass peaks. The actual mass units used to determine the relative amounts of each of the two enantiomers (labeled and unlabelled) are dependent on how the mass spectrometer is tuned.

Figure 14A:
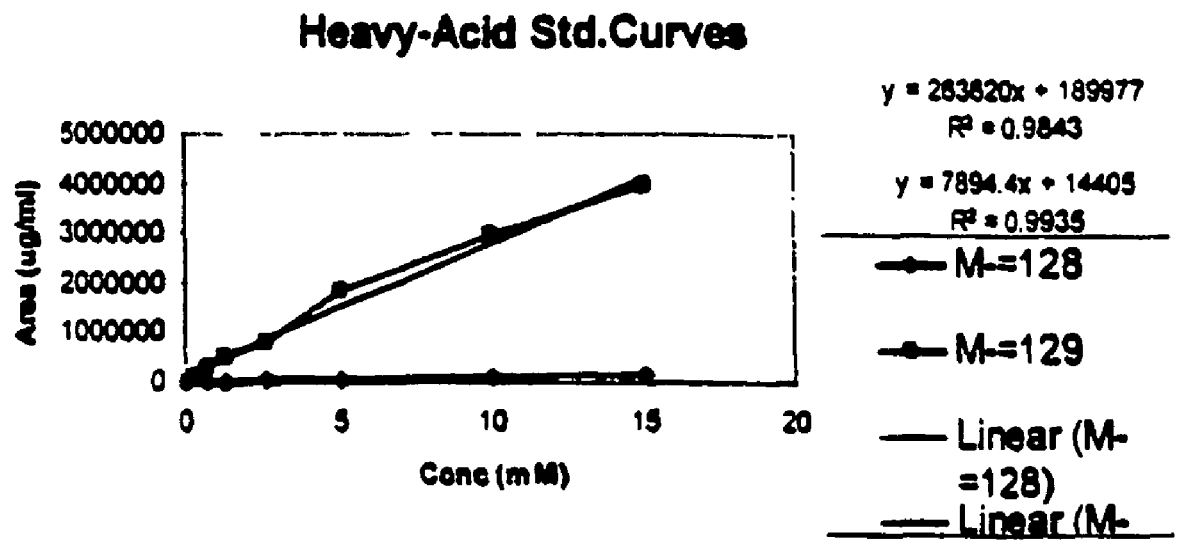
FIGS. 14A-14B illustrate two exemplary standard curves for quantitation in connection with the screening assay of the invention.
Figure 14B:
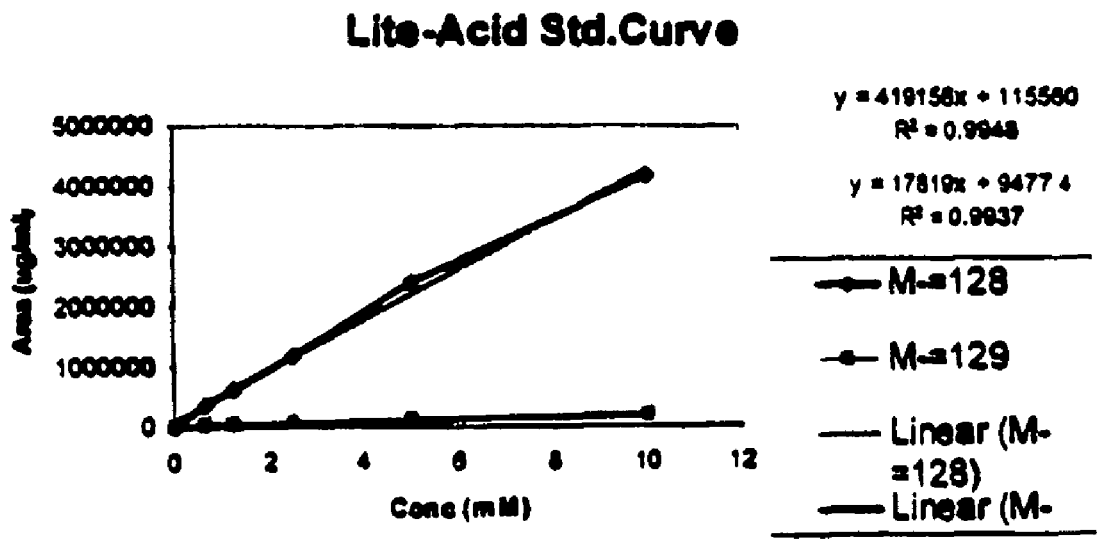

In some cases, the % ee observed by mass spectrometry may differ by a factor from that observed by an alternate analytical technique such as liquid chromatography due to background or contaminating peaks resulting from natural isotopic abundance. This does not, however, affect the final outcome of the screening process. Exemplary standard curves for quantification of heavy acid and light acid are shown in FIGS. 14 A and B.

The following reaction is a possible synthetic route to prepare, for example, 15N (R) —HGN using chemistry techniques known in the art with commercially available starting materials.

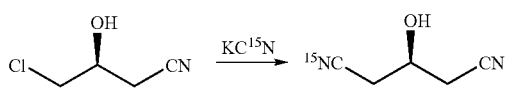

The amount of each of the two possible stereomeric outcomes can be established by the use of MS in either positive mode, negative mode and from analysis of either of the parental mass or of any fragmentation mass.

Example 23

Stability and Activity of Exemplary Enzymes of the Invention

Enzyme Stability:

Wild-type enzyme (SEQ ID NOS:209 and 210) was compared to mutant A190H of SEQ ID NOS:209 and 210. In the experiment, each enzyme was incubated at 10 mg/ml in water for 1, 25, 50, 75 and 150 hours at 4° C. and at 21° C., on two different substrates: adiponitrile and hydroxyglutaryl nitrile. Both enzymes, in all conditions, were found to retain activity for 150 hours. The wild-type enzyme showed greater activity on adiponitrile, while the mutated (A190H) enzyme showed greater activity on hydroxyglutaryl nitrile, as assessed by the Nitroprusside Bertholet assay (see, e.g., Fawcett, J. K. & Scott, J. (1960); J. Clin. Path.; Vol. 13, pg 156).

| GSSM ™ Variant of SEQ ID NOS:209 and 210 | 100 mM hydroxyglutaryl nitrile ee % | 2.25 mM hydroxyglutaryl nitrile ee % | Time to completion (hours) |
|---|---|---|---|
| A55G | 96.5 ± 0.4 | Not determined | >160 |
| A55K | 94.7 ± 0.2 | Not determined | >160 |
| I60E | 96.5 ± 0.5 | Not determined | >160 |
| N111S | 95.8 ± 0.5 | 96.1 ± 0.9 | >160 |
| A190T | 96.5 ± 0.2 | 96.6 ± 0.4 | 40 |
| A190S | 96.8 ± 0.2 | 95.5 ± 0.7 | 40 |
| A190H | 97.9 ± 0.1 | 98.1 ± 0.1 | 15 |
| F191L | 97.9 ± 0.1 | Not determined | >160 |
| F191T | 97.9 ± 0.1 | Not determined | >160 |
| F191M | 97.9 ± 0.1 | Not determined | >160 |
| F191V | 97.9 ± 0.1 | Not determined | >160 |
| M199E | 97.9 ± 0.1 | Not determined | 160 |
| M199L | 97.9 ± 0.1 | 95.4 ± 0.1 | >160 |
| Wild type SEQ ID NOS: 209 and 210 | 94.5 ± 0.1 | 87.8 ± 0.2 | 24 |

GSSM mutants with enhanced enantioselectivity 100 mM reactions were performed with nitrilase expressed from E. coli in whole cell format and were complete with 36 hours. 2.25 M reactions were performed with nitrilase as lyophilized clarified cell lysate. All % ee data reported are the average of three measurements, with standard deviation of the mean. The time for reaction completion was approximated by TLC.

Specifically:

Nitrilase Activity Assay, 100 mM HGN:

Putative nitrilase up-mutants were assayed in triplicate. Each transformant was grown in 5 mL LB (100 μg/mL ampicillin), at 37° C., 220 rpm for 18 h. The overnight culture was diluted 2-fold and nitrilase expression induced at 37° C., 220 rpm with 0.1 mM IPTG for 6 h. Cells were harvested by centrifugation, washed in 100 mM pH 7 sodium phosphate buffer and then re-suspended in 1 mL of 100 mM HGN in 100 mM pH 7 sodium phosphate buffer. Reactions were allowed to proceed for at least 36 h at 22° C. with gentle agitation. Reaction progress was monitored by TLC (1:1 EtOAc:Hexanes, Rf=0.5, nitrile; Rf=0.0, acid). Cells and other debris were removed by centrifugation and the treated with one volume methanol prior to lyophilization. The lyophilizate was re-suspended in methanol and treated with TMS-diazomethane (10 equivalents, 2 M solution in hexanes) until gas evolution ceased and yellow color persisted in order to prepare the methyl ester for GC analysis. Selected nitrilase variants producing (R)-(−)-3-hydroxy-4-cyanobutyric acid of 95% ee or greater were then evaluated for performance at 2.25 M HGN.

Nitrilase Activity Assay at 2.25 M 3-HGN:

3-HGN (0.2 g, 1.8 mmol, 3 M) was suspended in sodium phosphate buffer (0.6 mL, pH 7, 100 mM) at 22° C. Cell lysate (6 mg, normalized for nitrilase content) was added to bring the concentration to 11 mg/ml enzyme and the reaction shaken (100 rpm, 22° C.). Reaction progress was monitored by TLC (1:1 ethyl acetate:hexanes, Rf=0.32, nitrile; Rf=0.0, acid) The reaction mixture was treated with one part methanol prior to lyophilization. The lyophilizate was re-suspended in methanol and treated with 10 equivalents of TMS-diazomethane (10 equivalents, 2 M solution in hexanes) to prepare the methyl ester and analyzed by GC.

Description of Novel High Throughput LC/MS Method for Screening High Numbers of Samples:

Ultra High-Throughput Primary Chiral Activity Screen:

Distinct members of the GSSM library were arrayed into 384 well plates containing 40 μL of (Luria-Bertani) LB medium (100 μg/mL ampicillin) via an automated colony picker and then incubated at 37° C., 85% humidity. Nitrilase expression was induced with 0.1 mM IPTG at 37° C. for 24 h. Each plate was replicated and 20% glycerol stocks prepared for archival at −80° C. To each 384 well plate was added 10 mM 15N—(R)-1 substrate. The plates were incubated at 37° C., 85% humidity for three days. Cells and other debris were removed by centrifugation and the supernatant was diluted 17,576-fold prior to MS analysis.

LC/MS ionspray was applied for high through-put analysis in the following manner. High-throughput screening was achieved by flow injecting samples from 384-well plates using a CTCPAL autosampler (Leap Technologies, Carrboro, N.C.). An an isocratic mixture of 71% acetonitrile, 29% water, with 0.1% formic acid, provided by LC-10ADvp pumps (Shimadzu, Kyoto, Japan) at 2.2 mL/min through an LC-18 cartridge (Supelco, Bellefonte, Pa.) was used.

Samples were applied to an API 4000 TurboIon spray triple-quadrupole mass spectrometer (Applied Biosystems, Foster City, Calif.). Ion spray and Multiple Reaction Monitoring (MRM) were performed for analytes in the negative ion mode, and each analysis took 60 seconds.

E. coli transformed with wild type enzyme (SEQ ID NOS: 209 and 210) was used as a positive activity control and E. coli transformed with empty vector was used as the negative activity control. The % ee of the WT enzyme positive control determined by mass spectrometry using either 15N—(R)-1 or 15N—(S)-1 were the same, thus demonstrating the absence of a significant isotope effect.

| Temp (° C.) | pH | Sodium phosphate buffer conc. (mM) | % ee | Std. Dev. |
|---|---|---|---|---|
| 4 | 7 | 100 | 98.7 | 0.1% |
| 19 | 7 | 100 | 98.7 | 0.1% |
| 21 | 7 | 100 | 98.6 | 0.1% |
| 37 | 7 | 100 | 98.4 | 0.1% |
| 21 | 7 | 100 | 98.6 | 0.1% |
| 21 | 6 | 100 | 98.6 | 0.1% |
| 21 | 8 | 100 | 98.6 | 0.1% |
| 21 | 7 | 100 | 98.5 | 0.1% |
| 21 | 7 | 50 | 98.6 | 0.1% |
| 21 | 7 | 25 | 98.7 | 0.1% |

Effect of reaction parameters on SEQ ID NOS: 209 and 210 with the A190H mutation.

Reactions were performed at 3 M HGN concentration with 150 mg/ml protein (~49 mg/ml enzyme). % ee was determined by GC analysis in triplicate runs.

While the invention has been described in detail with reference to certain preferred aspects thereof, it will be understood that modifications and variations are within the spirit and scope of that which is described and claimed.

SEQUENCE LISTING (386 sequences)

SEQ ID NO: 1 - DNA, 939 bp, Unknown
  Obtained from an environmental sample
atggaaaagtatattaaagtcgccgcaattcagatagctacaaaaatagcagattcacccgtgaatatagaaaattgcgaacgtttggcattatcggcggtcaatgagggtgcgcgttggattgctttgccggagttcttcaatacgggcgttagttggaacaaaaaaattgccttggctattcagacgcctgacggcaaggctgcgatgttcttacgcgacttttctgcaagacatcatgtattgataggaggctcatttctgtgcaggttgccggatggcagtgtgcgcaaccgctatatgtgttatgccaacggcgctctcgtgggcaaacatgacaaagacctacccacgatgtgggaaaatgctttttatgaaggtggggattccagcgatattggggtgctgggaacatttgaaaatacgcgcgttggtgcagccgtctgttgggagttcatgcggacgatgactgcccggcgtcttcgcaatcaggtggatgtcatcatgggtggttcctgctggtggagcataccgaccaatttccccggttttgtgcaaaagctgtgggaacctggaaatagccgcaacgcgcttgctgccatacaggataatgcgcgtctcattggcgtgccggttgttcatgccgctcattgcggtgaaattgagtgtccgatgccaggattgccgataggttacagggggttctttgagggtaacgcggccattgtgaatgcagaaggtcaggtgcttgcgcatcggggtgctggcgagggcgaaggaattgtttgcgcggagattttaccggtagccaaatcaaacaggtcggaaattcccaatcgttactggttgcgctgcagaggctttctacctatttttgcctggcatcagcaacgttggttgggaaggcattggtatttgcgcaatgtgcgcaggacttaa

SEQ ID NO: 2 - protein, 312 aa, Unknown
  Obtained from an environmental sample
MEKYIKVAAIQIATKIADSPVNIENCERLALSAVNEGARWIALPEFFNTGVSWNKKIALAIQTPDGKAAMFLRDFSARHHVLIGGSFLCRLPDGSVRNRYMCYANGALVGKHDKDLPTMWENAFYEGGDSSDIGVLGTFENTRVGAAVCWEFMRTMTARRLRNQVDVIMGGSCWWSIPTNFPGFVQKLWEPGNSRNALAAIQDNARLIGVPVVHAAHCGEIECPMPGLPIGYRGFFEGNAAIVNAEGQVLAHRGAGEGEGIVCAEILPVAKSNRSEIPNRYWLRCRGFLPIFAWHQQRWLGRHWYLRNVRRT

SEQ ID NO: 3 - DNA, 981 bp, Unknown
  Obtained from an environmental sample
atggggaattcgttcaagatcgcggtggtacaagcctgtccggtctttctggatcgtggcgcgacagtcgccaaggcatgccgcctgatcgcggaggcagccgcggcgggcgccagcctggtggtctttccggaggcgtttgtgcccggatacccactgtgggtctggttcattccggcagggcattcgcaaccactgcgggagttatacgccgaactggtggggaacgccgtggcggtaccgggcgatgccaccgatcggctttgcgcggcagccagagaagccggcgtggtagtggcgatcggcatcaatgaagtgaacagcgaagccagcggcacgacgatttacaatacgctgctgtacatcggagcggacggcgcgattctgggcaaacaccgcaaagtaatgccgacgggcggagagcgcctggtctgggcgcttggcgatgggagcgacctggaggtctacgacctgcctttcggccgattgggtggcctgttgtgctgggagaactacatgcccctggcccggtacgcgatgtcggcatggggaaccgagatctacgtggctccaacttgggatcgcggagaaccgtggctgtccacaatgcggcatatcgcgaaagaagggcgatgctacgtagtgggatgctgcagttgcatgaaaattgacgatgtacccgaccggctggcgttcaaagggaagtatctgtcgacggccgagggctggctcaaccccggcgatagcgtaatcgtcgatccggacggcaagctgatcgcgggcccggcaagcgagcaggagacgattctgtatgccgatgccgaccggtctaagatcaccgggcccaggtggcagttggatgtggccggccactacgcgcggccggatatcttcgaactgatcgtgcaccgcgaacctaagcgatttttgacgatagctccgcggacgaaggaggagcgggagcctgggccggaggcctga

SEQ ID NO: 4 - protein, 326 aa, Unknown
  Obtained from an environmental sample
MGNSFKIAVVQACPVFLDRGATVAKACRLIAEAAAAGASLVVFPEAFVPGYPLWVWFIPAGHSQPLRELYAELVGNAVAVPGDATDRLCAAAREAGVVVAIGINEVNSEASGTTIYNTLLYIGADGAILGKHRKVMPTGGERLVWALGDGSDLEVYDLPFGRLGGLLCWENYMPLARYAMSAWGTEIYVAPTWDRGEPWLSTMRHIAKEGRCYVVGCCSCMKIDDVPDRLAFKGKYLSTAEGWLNPGDSVIVDPDGKLIAGPASEQETILYADADRSKITGPRWQLDVAGHYARPDIFELIVHREPKRFLTIAPRTKEEREPGPEA

SEQ ID NO: 5 - DNA, 1005 bp, Unknown
  Obtained from an environmental sample
atgggtaccaagcacccggccttcaaggccgcagtggtccaggccgcgccggaatggctcgatctcgaccgcaccgtcgacaagaccatcgcgctgatcgaggaggccgccggcgccggcgcgaagctcattgcgttcccggaaacctggattcccggctatccgtggcacatctgggtcggcacgccggcgtgggcgatcagccgcggcttcgtgcagcgctacttcgacaattcactggcctacgacagcccgcaggcccagcgcatcgcggacgccgcgaagaagaacaagatcaccgtggtgctcggcctgtcggagcgcgagggtggcagcctttatatctcgcagtggctgattgggccggacggcgagaccattgccaagcgccgcaaactgcgccccacccacgtcgagcgcaccgtgttcggcgatggcgacggcagccacatcgcggtgcacgagcgtgctgacatcggccgcctcggcgcgctgtgctgctgggagcacatccagccgctgaccaaatacgccatgtatgcccagaacgagcaggtgcacgtcgccgcctggccgagcttctcgatgtacgagccgttcgcccacgcgctcggctgggaagtcaacaatgcggcgagcaagatctacgccgtcgaaggctcgtgtttcgtgctcggcgcatgcgcggtgatctcgcaggcgatggtcgacgaaatgtgcgacaccgaggacaagcgggcgctggtccatgccggcggcggccacgcggtgatcttcgggccggacggcagatcgctggcggacaagattccggagacccaggaaggcctgctctatgccgacatcgacctcggcgcaattggcgtggccaagaacgcggccgatccggcggggcactactcgcgcccggacgtgacgcggctcctgttcaacaacaagccggcgcgccgggtcgagtatttctcgctgccggtcgacgcggtcgagacgccgccgcagccctga

SEQ ID NO: 6 - protein, 334 aa, Unknown
  Obtained from an environmental sample
MGTKHPAFKAAVVQAAPEWLDLDRTVDKTIALIEEAAGAGAKLIAFPETWIPGYPWHIWVGTPAWAISRGFVQRYFDNSLAYDSPQAQRIADAAKKNKITVVLGLSEREGGSLYISQWLIGPDGETIAKRRKLRPTHVERTVFGDGDGSHIAVHERADIGRLGALCCWEHIQPLTKYAMYAQNEQVHVAAWPSFSMYEPFAHALGWEVNNAASKIYAVEGSCFVLGACAVISQAMVDEMCDTEDKRALVHAGGGHAVIFGPDGRSLADKIPETQEGLLYADIDLGAIGVAKNAADPAGHYSRPDVTRLLFNNKPARRVEYFSLPVDAVETPPQP

SEQ ID NO: 7 - DNA, 999 bp, Unknown
  Obtained from an environmental sample
atgccgagtgattatcatgctccattcaaagtagcagttgtccaggcaactcccgtctttctcgatcgcagcgcgacgattgagaaggcatgtgagctaattgcctgtgctggacgtgagggcgcacgtctgatcgtgtttcctgaagcgttcattcccacctatcccgattgggtctggaccattccacctggggagatgcggctgcttggcgaactctacacagagttgcttgccaatgcggtcacgatccccagtaatgcaacggataggctctgccaggctgcgaaacgagctgctgcgtatgtggtcatgggaatgaacgaacgcaatatcgaggcgagtggaaggagtctctataacaccctgttatacatcgatgctcagggccagatcatgggcaaacaccgcaagttgatacccacagccggtgagcggctcatatgggcgcaaggagatgggagtacattccaggtctacgatactcctctgggcaaactgggagggctcatctgctgggaaaactacatgcctctggctcgctatgcgatgtatgcctggggcacgcagatttatgtcgccccgacatgggatcgtggcaacctctggctctctactctgcggcatatcgctaaggagggaggcgtctatgttcttggttgtagtatggtcatgcgcaagaatgacattcccgatcactttgctttcaaagagcagttttatgctactgtggacgaatggatcaacgttggtgacagcgccattgtccatcccgaggggaactttcttgcgggaccggtgcgccacaaagaagagattctctatgcagaacttgatccacgccaatcgtgcggtccgggatggatgctcgatgtggctgggcactatgcacgccctgatgtgtttgaattgattgtccacacagagatgcgacccatgatgaagcaagaagaggtaggaggagaaaatacatctgagggaggtgtacgattcttgtaa

SEQ ID NO: 8 - protein, 332 aa, Unknown
  Obtained from an environmental sample
MPSDYHAPFKVAVVQATPVFLDRSATIEKACELIACAGREGARLIVFPEAFIPTYPDWVWTIPPGEMRLLGELYTELLANAVTIPSNATDRLCQAAKRAAAYVVMGMNERNIEASGRSLYNTLLYIDAQGQIMGKHRKLIPTAGERLIWAQGDGSTFQVYDTPLGKLGGLICWENYMPLARYAMYAWGTQIYVAPTWDRGNLWLSTLRHIAKEGGVYVLGCSMVMRKNDIPDHFAFKEQFYATVDEWINVGDSAIVHPEGNFLAGPVRHKEEILYAELDPRQSCGPGWMLDVAGHYARPDVFELIVHTEMRPMMKQEEVGGENTSEGGVRFL

SEQ ID NO: 9 - DNA, 945 bp, Unknown
  Obtained from an environmental sample
atggcggctcacaagatcgcggtggttcaggcgcccagcgttctcctcgatcgcgagggctcggtcgcgcgcgcggtcacgctgctcgacgaggcggcggcggccggcgcccgcctggtcgtgtttccggaggcctacatccccggctacccggactggatctggcgcctgcgcccctacccggacgtcaagctggccgccgagctgcacgaacggctgctcgccaacgcggtggatctctccaccgacgtgctggcgccggtgctggcggcggcggcgcgtcacgggctcaccgtggtcatgtgcgtgcaggagcgcgacgccggattcagccgcgccacactttacaacaccgcgctggtcatcgacgccgccggcaagatcgcgaaccggcaccgcaagctcatgcccaccaaccccgagcgaatggtgtggggattcggtgacgcctcggggctgcgggtggtgagcacgcccgtcgggcgggtgggcacgctcctgtgctgggagagctacatgcccctggcgcgctgcgcgctctacgccgagggggtcgagatctacgtgaccccgacctgggactacggcgaaggctggcgcgccagcatgcagcacatcgcccgcgaggggcgctgctgggtggtgaccgcttgcatgtgcgtgcaggcgcgcgacgtgccggccgacttccccgggcgcgcccagctctaccccgacgaggaggagtggttgaaccccggcgattcgctggtggtcgaccccggcggcaagatcgtggccggtccgatgtcgcgcgagaaggggatcttgtacgcggagatcgatccggatcgcgtggcgggggcgcaccgctcgttcgacgtcgtgggccactactcgcgtcccgacgtgttccggctggaggtcgatcggacaccggcggcgccggtgagcttcaaaaaatga

SEQ ID NO: 10 - protein, 314 aa, Unknown
  Obtained from an environmental sample
MAAHKIAVVQAPSVLLDREGSVARAVTLLDEAAAAGARLVVFPEAYIPGYPDWIWRLRPYPDVKLAAELHERLLANAVDLSTDVLAPVLAAAARHGLTVVMCVQERDAGFSRATLYNTALVIDAAGKIANRHRKLMPTNPERMVWGFGDASGLRVVSTPVGRVGTLLCWESYMPLARCALYAEGVEIYVTPTWDYGEGWRASMQHIAREGRCWVVTACMCVQARDVPADFPGRAQLYPDEEEWLNPGDSLVVDPGGKIVAGPMSREKGILYAEIDPDRVAGAHRSFDVVGHYSRPDVFRLEVDRTPAAPVSFKK

SEQ ID NO: 11 - DNA, 966 bp, Unknown
  Obtained from an environmental sample
atgactggatcttatcctaaagacacactgatcgttgggctagctcaaatcgctcctgtctggctggatcgggcggggacactgtcaaagatactggctcaagtccatgcggcaaatcaagcgggttgtcatctcgtagcatttggcgaagggctgcttcctggatatccgttttggattgagcgaacaaatggcgcgctgttcaactcgactgtacaaaaggaaatccacgcgcattatatggatcaggcggtgcagatcgaagccggtcatctcgatccgctttgtgcaacagccaagaaatttggaatcaccgttgtactcggatgcatcgaacgcccactcgatcggggcggtcacagcttgtatgcaagtctggtatatattgattccgagggcagcattcaatccgtgcatcgcaaactaatgccaacctacgaagaacgacttacctggtcgtcaggcgatgggcacggtttacgagtgcataccttaggtgcgtttacggtgggtggtctcaactgttgggaaaattggatgcccttggcgcgcgcagcgatgtatggtcagggtgaagatttacatgttgcgatctggccaggcggttctcatctcacgcaggatattacccgctttattgcgctcgaatcacgttcgtacgtattatctgtctccggtctgatgcgcgcaaccgattttccaaaagatactccccatcttgcctccatcctagctaaaggtgaagagattcttgcgaatggtggttcttgtattgcaggtcctgacggcaagtgggtcgttgggcctcttgtaggagaagagaagttaattgtcgcaaccattgatcactgccgcgtgcgcgaagaacgtcagaatttcgatccttccgggcattacagccggcccgatgtactgcaattaaaaatcaacagggaacgccagagcacaatttcatttagcgagtag

SEQ ID NO: 12 - protein, 321 aa, Unknown
  Obtained from an environmental sample
MTGSYPKDTLIVGLAQIAPVWLDRAGTLSKILAQVHAANQAGCHLVAFGEGLLPGYPFWIERTNGALFNSTVQKEIHAHYMDQAVQIEAGHLDPLCATAKKFGITVVLGCIERPLDRGGHSLYASLVYIDSEGSIQSVHRKLMPTYEERLTWSSGDGHGLRVHTLGAFTVGGLNCWENWMPLARAAMYGQGEDLHVAIWPGGSHLTQDITRFIALESRSYVLSVSGLMRATDFPKDTPHLASILAKGEEILANGGSCIAGPDGKWVVGPLVGEEKLIVATIDHCRVREERQNFDPSGHYSRPDVLQLKINRERQSTISFSE

SEQ ID NO: 13 - DNA, 1014 bp, Unknown
  Obtained from an environmental sample
atgggcattcaacatccgaaatataaggttgcggtggtgcaggcggcgccggcctggctcgatctcgatgcgtcgatcgccaaatcgatcgcgttgatcgaggaggcggctgccaatggcgccaagctgatcgccttcccggaggcgttcatccctggctatccctggtatatctggctggactcgccggcctgggcgatcggccgcggttttgtgcagcgctatttcgacaactcgctggcctatgacagcccgcaggccgagaagctgcggctggcggtgaagaaggccggcctcaccgccgtgatcggcctctccgagcgcgagggcggcagcctttatctcgcgcaatggctgatcgggcccgatggcgagaccatcgcaaagcgccgcaagctgcggccgacccatgccgagcgcaccgtctatggcgaaggcgatggcagcgatctcgcggtgcatgaccgccccggcatcggccggctcggcgcgctgtgctgctgggagcatctgcagccgctgtcgaaatacgcgatgtatgcccagaacgagcaggttcatgtcgcggcctggccgagcttctcgctctacgacccgttcgcgccggcgctcggctgggaggtcaacaatgcggcctcacgcgtctatgcggtggaaggctcgtgcttcgtgctggcgccctgcgcgacggtgtcgaaggcgatgatcgacgagctctgcgaccgcgacgacaagcacgggctgctgcatgtcggcgggggacacgccgcgatctatgggccggacggctcttcgattgcggagaaattgccgccggagcaggagggcctgctctatgccgacatcgatctcggcgccatcgggattgccaagaacgccgccgatccggccggacattactcgcggcccgacgtgacgcggctgttgctcaacaagaagccgtcgaagcgtgtcgagcatttttcgctgccggtcgacaatgtcgagccggagatcgacgccgccgccagctga

SEQ ID NO: 14 - protein, 337 aa, Unknown
  Obtained from an environmental sample
MGIQHPKYKVAVVQAAPAWLDLDASIAKSIALIEEAAANGAKLIAFPEAFIPGYPWYIWLDSPAWAIGRGFVQRYFDNSLAYDSPQAEKLRLAVKKAGLTAVIGLSEREGGSLYLAQWLIGPDGETIAKRRKLRPTHAERTVYGEGDGSDLAVHDRPGIGRLGALCCWEHLQPLSKYAMYAQNEQVHVAAWPSFSLYDPFAPALGWEVNNAASRVYAVEGSCFVLAPCATVSKAMIDELCDRDDKHGLLHVGGGHAAIYGPDGSSIAEKLPPEQEGLLYADIDLGAIGIAKNAADPAGHYSRPDVTRLLLNKKPSKRVEHFSLPVDNVEPEIDAAAS

SEQ ID NO: 15 - DNA, 1047 bp, Unknown
  Obtained from an environmental sample
atgccaacatcaaaacaatttagagtcgctgcagttcaagccgccccggtatttcttgacctggagggcgcaataagcaaaggcatctccctcattgaggaggccgcttccaatggagccaagctcattgccttcccggaaacgtggattcccggctacccctggtggatctggctggactcacccgcttggggcatgcgctttgtccagcgctattttgacaactcgctcatgctgggtagtgagcaagccaagcgcatgaaccaggctgccgccaataacaagatttacgtggtgatgggttatagcgaacgcagtggcggcagcctctacatgggccaatccattatcaacgacaagggtgaaacgatttttacccgccgcaaactcaagccaactcatgtcgagcgtaccgtgtttggggagggagacggcagccatctttgcgtaatggataccgagattggccgcgtcggcgcgatgtgctgttgggaacatttgcagccgctcagcaaatatgcaatgtattctcaggatgaacaaattcacattgcctcctggccgagcttttcgttatatcggggggcagcctatgcactcggccccgaactgaacaacgccgccagccaaatgtatgcagccgaaggccagtgctttgtccttgccccttgcgccaccgtctcaaaggagatgatcgaaatgctgatagatgatcccaggaaagagccgcttctgctggaaggtggcgggttcaccatgatttacggccccgatgggcgacctctggctaaaccgttgcctgaaaacgaggaagggctgctatatgccgatattgacctgggcatgatttcaatggccaaggctgccgccgacccggcaggtcactacgcacgcccggatgtcactcgcctactattcaattccgcgcccgccaatcgcgtcgagtatatcaacccagcgtcaggcccaaccgaatccttaaaagatatgggaaagatgcaaatggaggccgaacagcaaaaggcggccctgcgagagatgatctaa

SEQ ID NO: 16 - protein, 348 aa, Unknown
  Obtained from an environmental sample
MPTSKQFRVAAVQAAPVFLDLEGAISKGISLIEEAASNGAKLIAFPETWIPGYPWWIWLDSPAWGMRFVQRYFDNSLMLGSEQAKRMNQAAANNKIYVVMGYSERSGGSLYMGQSIINDKGETIFTRRKLKPTHVERTVFGEGDGSHLCVMDTEIGRVGAMCCWEHLQPLSKYAMYSQDEQIHIASWPSFSLYRGAAYALGPELNNAASQMYAAEGQCFVLAPCATVSKEMIEMLIDDPRKEPLLLEGGGFTMIYGPDGRPLAKPLPENEEGLLYADIDLGMISMAKAAADPAGHYARPDVTRLLFNSAPANRVEYINPASGPTESLKDMGKMQMEAEQQKAALREMI

SEQ ID NO: 17 - DNA, 993 bp, Unknown
  Obtained from an environmental sample
atgagagttgttaaagccgcagctgtccaactgagtcccgtcctctatagccgcgagggaacggtcgagaaggtcgtgcggaagatccatgaacttgccgaagagggagtcgagttcgtcacctttcctgagaccgtggtgccttattacccgtacttttcgttcgttcagacgcccttgcagcaaatcttcggaacagagtatctgaggctgctcgaccaggcagtcaccgtgccatccgccgccaccgacgcgatcggcgaggctgccaggttcgctggagttgttgtctcgatcggcgtcaacgagcgagacgggggaactctgtacaacactcagcttctcttcgatgccgacggaagcttaattcagcggcgccgcaagatcacgcccacccattacgagcgcatgatctggggccagggtgacggctcaggtctgcgggccgttgatagcaaggccggccgcattggtcagctggcatgctgggagcacaacaatccactggcgcgctacgcgctgatagccgacggcgagcagatccattcggccatgtatccgggctccatgttcggcgactcgtttgccaaaaagaccgaaatcaatatccggcagcatgcgctggagtctgcgtgcttcgtcgtgaacgcaacggcctggctggacggcgatcaacaggcgcaaatcatgaaggacaccggctgcagcatcggcccgatctccggcggttgcttcaccactatcgtggcgccggacggttccctgatcggcgagcccctccgctcgggtgagggcgtggtcatcgccgacctcgacttcacgttaatcgacaggcgtaagcaggtgatggactcgcgaggccactacagccggccggagttgctcagcctcttaatagaccgcacccctaccgcgcactttcacgaacgcgcttcgcaccccacgacaggagctgagcaaggctccgaggatgtgttcgaggctaacatttaa

SEQ ID NO: 18 - protein, 330 aa, Unknown
  Obtained from an environmental sample
MRVVKAAAVQLSPVLYSREGTVEKVVRKIHELAEEGVEFVTFPETVVPYYPYFSFVQTPLQQIFGTEYLRLLDQAVTVPSAATDAIGEAARFAGVVVSIGVNERDGGTLYNTQLLFDADGSLIQRRRKITPTHYERMIWGQGDGSGLRAVDSKAGRIGQLACWEHNNPLARYALIADGEQIHSAMYPGSMFGDSFAKKTEINIRQHALESACFVVNATAWLDGDQQAQIMKDTGCSIGPISGGCFTTIVAPDGSLIGEPLRSGEGVVIADLDFTLIDRRKQVMDSRGHYSRPELLSLLIDRTPTAHFHERASHPTTGAEQGSEDVFEANI

SEQ ID NO: 19 - DNA, 1050 bp, Unknown
  Obtained from an environmental sample
atggaaagcaacttccttgccgcagcagtgcaagcagaaccggtttacttcaatgcttttcagacggccgaaaaggccgcgtcattgattgacgatgccggtcggcagggggctcgcttagtgacatttcccgaaacgtggctgcccggttacccgtactggatctggcttggtgcccccgcctggggaatgcatcatttcatcctaaagtaccatcaaaactcgccggttgcaggaggaccagaggaacagatcctttgtcaggcggcccgccgcaacgggatttttgtcgtcatgggactcagcgagaaaatcggggcaagcctctacatggcgcagtggttcatcagtccagacggcaaagtggtcgctcgccgacgcaaattgaagcctactcacgtcgaacgttcggtcttcggggaaggggatggttccgacattgtcgttcttgatacaccccttggaaaggtcgggggcctttgctgctgggagcacatgcagccactttcgaagtacgccatgtactcgcaaggcgagcagatccatgctgcttcttggccgagtgttagcgtctatcgcgataaaatttacgttctggggccggagctgaacggtgccgccaatcagatgtatgcggcagaaggtcagtgtttcgtcctggcatcctgggcaacggtttcacaagcggctatcgatcttttttgcgacacgcccgacaaggccgcgctcatgaaaattggtggtggtttttcccagatctatgggccagacgggtgccccctggcgaagccgttgccggaggacgtcgaaggattggtgaccgctgagattgacttcaatgccatcacgcgcgtgaaagcagcggcggaccccgtagggcactatagccggcccgatgtattccgcctgttgttcaatcgtacgcgccaagaacgcgtggtttctgtcaacacgtttgtgccaggtgtcacccagcgaaccgccaagaatgggtcggcggacgaattggtcggtcacccggagaacgctgtcgcccgggctgcagagtaa

SEQ ID NO: 20 - protein, 349 aa, Unknown
  Obtained from an environmental sample
MESNFLAAAVQAEPVYFNAFQTAEKAASLIDDAGRQGARLVTFPETWLPGYPYWIWLGAPAWGMHHFILKYHQNSPVAGGPEEQILCQAARRNGIFVVMGLSEKIGASLYMAQWFISPDGKVVARRRKLKPTHVERSVFGEGDGSDIVVLDTPLGKVGGLCCWEHMQPLSKYAMYSQGEQIHAASWPSVSVYRDKIYVLGPELNGAANQMYAAEGQCFVLASWATVSQAAIDLFCDTPDKAALMKIGGGFSQIYGPDGCPLAKPLPEDVEGLVTAEIDFNAITRVKAAADPVGHYSRPDVFRLLFNRTRQERVVSVNTFVPGVTQRTAKNGSADELVGHPENAVARAAE

SEQ ID NO: 21 - DNA, 1065 bp, Unknown
  Obtained from an environmental sample
atggcactagaacatccgaagtacgtggcggccgtggttcaggccgcgcccgaattcctgaatctagacagagggatcgaaaagacgatcgcattgatcgacgaagcgggacagaaaggggcggccctgattgcatttccggaaacctggctgccgggctatccgtttcatgtctggctcggtcctcccgcatgggcgcttggctcaggattcgtccagcgctatttcgacaactcgatgacgtacgatagtcctcaggccgctgcactgagggacgctgccgcgcgcaacgggatcacggtggtattgggcttgtcggagcgatgcggcggcagcctctatatcgcgcaatggatcatcggcccggatggcgcgacggtcgccacgcgccgcaaattgcggccgactcatatcgagcgcaccgttttcggcgatggcgacggcagcgatctggcagtacacgatctcaacatcggccgccttggcgcactgtgctgctgggagcacattcagccgctgaccaagtacgcgatgtatgcgcagcacgaacaggtgcacgtcgcggcctggccgagcttctccatgtatgaattcgcgcccgcgctcggtcacgaggtgaacaacgcagtcagccgcgtctatgccgttgagggatcgtgcttcgtgctcgcgccgtgcgcggtcatcagcgagcaaatggtcgacatgttgtgcgacacggcagacaagcgcgcgatgatacgtgccggcggcgggcacgcagtggcgttcgggccggacggcgaagctctggtcgagaaactgccggaaaatgaggaaggcttgctgctggtcgatatcgatctcggtcgcatctcgcttgcgaaggctgcggccgaccccgtcggtcactacgcgcgccccgatgtcttgcggctctggttcgacaagcaaccgcggcggtgcgtcgaacatgccggcgagaacgacgcgtcgcgcaggtcgcacgggtcgtccgggtcacaatcgccggcgcaggatgggccggcgaacgacatggtagaccgtcaggaaaacgtcgattga

SEQ ID NO: 22 - protein, 354 aa, Unknown
  Obtained from an environmental sample
MALEHPKYVAAVVQAAPEFLNLDRGIEKTIALIDEAGQKGAALIAFPETWLPGYPFHVWLGPPAWALGSGFVQRYFDNSMTYDSPQAAALRDAAARNGITVVLGLSERCGGSLYIAQWIIGPDGATVATRRKLRPTHIERTVFGDGDGSDLAVHDLNIGRLGALCCWEHIQPLTKYAMYAQHEQVHVAAWPSFSMYEFAPALGHEVNNAVSRVYAVEGSCFVLAPCAVISEQMVDMLCDTADKRAMIRAGGGHAVAFGPDGEALVEKLPENEEGLLLVDIDLGRISLAKAAADPVGHYARPDVLRLWFDKQPRRCVEHAGENDASRRSHGSSGSQSPAQDGPANDMVDRQENVD

SEQ ID NO: 23 - DNA, 1005 bp, Unknown
  Obtained from an environmental sample
atgaccgttatcaaagcagccgccattcaaatcagccccgtgctctacagccgggcggggacagtcgagaaagttgttaggaaggttagagagctcggggccaaaggtgtccgattcgctacctttcccgaaaccatcataccgtactacccgtacttctcgttcgttcagtcggcgttcgacatgaagcttgggagtgaacatcagcggctgctcgacgaatcagtcacaattccttcgtccgagacggacgcgatcgcccaggccgccaaggaagcgggcatggtggtgtccgtcggggtcaatgagcgcgatgggcgatccatctacaacactcaacttctgttcgacgctgatggcacgctcattcagcgtaggcgaaagatcaccccgacctatcacgagcgcatgatttggggtcaaggcgatggatccggcctacgcgcggtcgatagcgccgtgggccggatcggccagcttgcctgctgggagcactaccttcccctggcgcggtacgccctcatcgcggacggagagcaaatccactcggcaatgtatccaggctcgttcgctggtccgctatttgccgagcagatagaggttagtatccgccagcacgcgcttgagtcagcctgcttcgtcgtcaacgcgaccggatggcttagcgccgagcagcaagctcaaatagtgaaggataccggatgcgtcgttggaccaatctccggtggctgctttacggcgattgttgatccggagggtcggatcatgggggcgccactcaaggcaggtgagggggaggtcatcgcagatctcgattttgcgcagattgatttccgcaagcgtgtgatggatacgcgagggcactacagccgccccgaacttctaagcctcacgatcgaccgcagtcagcaccatcacatgactgagcgaggcgccgatcaccgtgtagaccacgcaaagccaacggtcaccgcagagcagtcggccgtcgagccggcggaatga

SEQ ID NO: 24 - protein, 334 aa, Unknown
  Obtained from an environmental sample
MTVIKAAAIQISPVLYSRAGTVEKVVRKVRELGAKGVRFATFPETIIPYYPYFSFVQSAFDMKLGSEHQRLLDESVTIPSSETDAIAQAAKEAGMVVSVGVNERDGRSIYNTQLLFDADGTLIQRRRKITPTYHERMIWGQGDGSGLRAVDSAVGRIGQLACWEHYLPLARYALIADGEQIHSAMYPGSFAGPLFAEQIEVSIRQHALESACFVVNATGWLSAEQQAQIVKDTGCVVGPISGGCFTAIVDPEGRIMGAPLKAGEGEVIADLDFAQIDFRKRVMDTRGHYSRPELLSLTIDRSQHHHMTERGADHRVDHAKPTVTAEQSAVEPAE

SEQ ID NO: 25 - DNA, 939 bp, Unknown
  Obtained from an environmental sample
gtgtcatcaactatcaaagtcgccattattcaggccgctcctgcttactacgacctgcaggcgtcgctggcaaaggccgccagtctgatccgcgaggcggcacgcggcggcgcgcaattcgtcgcgttcggggagacatggctgccgggctatccgatgtggctggattggtgtcctggcgcgatcatctgggataaccccgccaccaaaaccgtcttcgcgcgcctccatgaaaacagcgtcgccgttcccggcagggaaacggcatttctcgccgaccttgcgatgtcgttaagcatcgtattatgcatcggcgtcaatgagaaggtcatgaatgggccgggacacggcacgctctacaacacgctcctgacgtttgatgcaacgggtgaaatcatcaatcatcatcgcaagttgatgccaacctatggcgagagattggtatgggggccgggcgacgcagttggcgtgcaagcggttgatagtacggtcgggcgcatcggcgggctgatctgttgggagcactggatgccgctgccacgccaactcatgcacaacagcggcgagcagattcacgtctgcgcatggccgggcgtgcacgaaatgcaccagatcgcgagccgtcattatgcattcgagggccgctgctttgtgctggccgccggattgatcatgcccgcgttcgacctgcccagcgaactcgaatttccgcccgaactggccgacaagcgcgactatctcctaatgaacggcggcagcgccatcatcaagcccaatggcaaatatctcgccgggccggtttatgacgaagagactattctctgcgccgaccttgacctgactgagaacatcaaggagcagatgacgctggacgtgacagggcattatgcgcgagcggaactgtttgacttgaatgtggtgcggcggcggaatgcgtag

SEQ ID NO: 26 - protein, 312 aa, Unknown
  Obtained from an environmental sample
VSSTIKVAIIQAAPAYYDLQASLAKAASLIREAARGGAQFVAFGETWLPGYPMWLDWCPGAIIWDNPATKTVFARLHENSVAVPGRETAFLADLAMSLSIVLCIGVNEKVMNGPGHGTLYNTLLTFDATGEIINHHRKLMPTYGERLVWGPGDAVGVQAVDSTVGRIGGLICWEHWMPLPRQLMHNSGEQIHVCAWPGVHEMHQIASRHYAFEGRCFVLAAGLIMPAFDLPSELEFPPELADKRDYLLMNGGSAIIKPNGKYLAGPVYDEETILCADLDLTENIKEQMTLDVTGHYARAELFDLNVVRRRNA

SEQ ID NO: 27 - DNA, 1056 bp, Unknown
  Obtained from an environmental sample
atgccaacccccagcgatcatttcaaaatcgccgctgttcaggcctcgcccgtgtttctggaccgggaggccactgtggaaaaggcctgccggttgatcgccgaagccgcaaagcagggcgcccgcctcatcgtctttccggaatctttcatcccgacctacccggattgggtgtgggccgttcccccgggaagggaaagaatcctgaaccagctgtattctgaattcctggccaatgccgtcgatgttcccggcgcggcgaccgaacaacttgcccaggctgcacgaatggccggcgcctatgtgattatgggcgtcaccgaaagagacacctcggccagcggggccagcctctacaacaccctgctctacttcagccccgaaggcatcctaatgggcaaacaccggaagctggttcccacggggggcgaacggctggtctgggcctacggagacggcagcacgctggaggtctacgacactccgctgggaaagatcggcgggctgatctgctgggagaactacatgcccctggcccggtacacgatgtacgcctggggcacccagatttacatcgccgccacctgggaccgcggggaaccgtggctctccaccctgcggcatatcgccaaggaaggaagggtctacgtcatcgggtgctgcatcgccctgcgccagggggatatcccggaccggttcgagtacaagggaaaattttattccgggtcccgggagtggatcaatgagggcgacagcgccatcgtgaacccggacggggaattcatcgccgggccggtgcggatgaaggaggagatcctgtatgccgagatagacccccggcagatgcggggccccaagtggatgctcgatgtggccggtcattacgcccggccggatatcttcgagctcatcgtccaccggaatccccacccgatgatcaaaatcgccgaagacaggggcacggggatcgcctcaagtttgattcgcccccgccctaaccttcccccatcaagggggaggaaatcggcaagaagcaaacgcaagcccaaaaaatga

SEQ ID NO: 28 - protein, 351 aa, Unknown
  Obtained from an environmental sample
MPTPSDHFKIAAVQASPVFLDREATVEKACRLIAEAAKQGARLIVFPESFIPTYPDWVWAVPPGRERILNQLYSEFLANAVDVPGAATEQLAQAARMAGAYVIMGVTERDTSASGASLYNTLLYFSPEGILMGKHRKLVPTGGERLVWAYGDGSTLEVYDTPLGKIGGLICWENYMPLARYTMYAWGTQIYIAATWDRGEPWLSTLRHIAKEGRVYVIGCCIALRQGDIPDRFEYKGKFYSGSREWINEGDSAIVNPDGEFIAGPVRMKEEILYAEIDPRQMRGPKWMLDVAGHYARPDIFELIVHRNPHPMIKIAEDRGTGIASSLIRPRPNLPPSRGRKSARSKRKPKK

SEQ ID NO: 29 - DNA, 1017 bp, Unknown
  Obtained from an environmental sample
atgggcatcgaacatacgaaatacaaggtggcggtggtgcaggcggcgccggcctggctcgacctcgaggcctcgatcggcaagtccatcggcctaatcaaggaggccgcggacaagggcgccaagctgatcgcctttccggaggccttcatccccggttacccctggtatatctggatggactcgccggcctgggcgatcggccgcggcttcgtccagcgctatttcgacaattcgctctcctacgacagtccccaggccgagcggctgcgtgatgccgtgcgccaggccaagctcaccgccgtgatcggcctgtccgaacgcgacggcggcagcctttacctggcgcaatggttgatcgggcccgacggcgaaaccattgccaagcgccgcaagctgcggccgacccatgccgagcgcaccgtctatggcgaaggcgacggcagcgatctggccgtacatgcccggcccgacatcggtcgcttgggcgcgctgtgctgctgggagcatcttcagccgttgtcgaagtacgcaatgtacgcccagaacgagcaggtccacgtcgctgcctggccgagcttctcgctctacgatcccttcgccccggcgctcggcgccgaggtcaacaacgctgcctcgcgcgtctatgcggtggagggctcctgcttcgtgctcgcgccttgcgcgacggtgtcgcaggccatgatcgacgaactctgcgatcggcccgataagcatgcgctgctgcatgccggcggaggctttgccgcgatctacggccccgacggcagccagatcggcgagaagctggcgccggatcaggagggtctgctgatcgccgagattgatctgggcgccatcggtgttgccaagaacgcggcagatcccgccggtcattattcacggccggatgtgacgcggttgctgctcaacaagaagcggtaccagcgcgtcgagcaatttgccttgcccgccgacatggtcgagcccgcggacataggcgcggcggcgagctga

SEQ ID NO: 30 - protein, 338 aa, Unknown
  Obtained from an environmental sample
MGIEHTKYKVAVVQAAPAWLDLEASIGKSIGLIKEAADKGAKLIAFPEAFIPGYPWYIWMDSPAWAIGRGFVQRYFDNSLSYDSPQAERLRDAVRQAKLTAVIGLSERDGGSLYLAQWLIGPDGETIAKRRKLRPTHAERTVYGEGDGSDLAVHARPDIGRLGALCCWEHLQPLSKYAMYAQNEQVHVAAWPSFSLYDPFAPALGAEVNNAASRVYAVEGSCFVLAPCATVSQAMIDELCDRPDKHALLHAGGGFAAIYGPDGSQIGEKLAPDQEGLLIAEIDLGAIGVAKNAADPAGHYSRPDVTRLLLNKKRYQRVEQFALPADMVEPADIGAAAS

SEQ ID NO: 31 - DNA, 933 bp, Unknown
  Obtained from an environmental sample
atgaccagaatagccattattcagcgaccgcccgtgctgctcgatcgaagcgccaccattgcccgggccgtgcaatcggtcgccgaagcggcagcgcaaggcgcgaccctgattgtcttgcccgaatcgtacatccctggctatccctcatggatctggcggctcgcgcctggcaaagacggcgcgatcgtgggccagttgcatgcgcgcttgctggccaatgcggtcgacctgagcagcactgacctcgatgcgcttcttgaagcggcccgtcagcacggcgtgaccattgtttgcggcatgaacgagtgcgaacggcgtcgcggcggcggcaccttgtacaacacggtggtcgtgatcggaccggacggcgtcatgctcaaccggcatcgcaaattgatgccgaccaatcccgagcgcatggtgcatggctttggcgatgcatccggactgaaagcagttgatacgcctgccggccggctgggcacgctgatctgctgggagagctacatgccgctggcacgctatgccctgtacgagcaaggcatcgagatctacatcgcaccaacttatgacagtggtgacggctggatcagcaccatgcgccacattgcactcgaagggcgctgctgggtgattggcagcggcacggtcctgaaaggcagtgatattccggacgatttcccggaacgggcacgcctgttccctgatccggatgagtggatcaacgatggtgattcggtagttatcgatccgcagggaaagatcgttgccggtccgatgcgtagggaagcaggcattctatacgccgatatcgacgtcgcgcgcgtagcaccatcacgccgcacgctggatgtcgcggggcattacgcgcgtccggacgtcttcgagcttcgggtacaccaggcaccgggggcacgagtaagtaattga

SEQ ID NO: 32 - protein, 310 aa, Unknown
  Obtained from an environmental sample
MTRIAIIQRPPVLLDRSATIARAVQSVAEAAAQGATLIVLPESYIPGYPSWIWRLAPGKDGAIVGQLHARLLANAVDLSSTDLDALLEAARQHGVTIVCGMNECERRRGGGTLYNTVVVIGPDGVMLNRHRKLMPTNPERMVHGFGDASGLKAVDTPAGRLGTLICWESYMPLARYALYEQGIEIYIAPTYDSGDGWISTMRHIALEGRCWVIGSGTVLKGSDIPDDFPERARLFPDPDEWINDGDSVVIDPQGKIVAGPMRREAGILYADIDVARVAPSRRTLDVAGHYARPDVFELRVHQAPGARVSN

SEQ ID NO: 33 - DNA, 1026 bp, Unknown
  Obtained from an environmental sample
atgttaagtcccgtgacgcagtatcgcgccgccgcggtgcaggcggcgccatcttttctcgatctcgaccgcaccgtcgagaagacgatcgcgatcatcgagcaggcggccgagcaggatgtgcgcctgatcgcgtttccggaaacctggattcccggctatccgctctggatctggctcggctcgccggcctggggcatgcgcttcgtgcagcgctatttcgagaactcgctggtgcgcggcagcaaacagtggaacgcgatcgccgatgcggcgcggcgccaccgcatgaccgtcgtcgtcggcttcagcgagcgcgcgggaggcagcctctacatgggccaggcgatcttcggccccgaaggcgagctcatcgcggcgcgccggaagctcaagccgacacacgccgagcgaacggtgttcggcgagggcgacggcagccacttggccgtttacgagacgggcgttggtcgcatcggcgccctctgctgctgggagcacatccagccgctctcgaaatacgcgatgtatgcggccaacgaacaggtgcatgtggcctcgtggccgtgcttcagcctttatcgcggcatggcctatgcgctcgggccggaggtgaacaccgccgcgagccaggtctacgcggtcgagggcggctgctacgtgctggcctcctgtctcgtcgtgacacccgagatcctgaaggtgctgatcgacacgcccgacaaggagccgttgctgctcgccggcggggggttctcgatgatcttcggccccgacggccgcgcgctcgcccagccgctgccggagaccgaagaggggctcgtcacggccgagatcgatctcggcgcgatcgcgctcgccaaggccgcggccgatcccgccggccattacgcgcggcccgacgtgacgcggttgttgctgaacccgcgccccgcggcgcgcgtcgaagcgctgggtccgcgcttcgaggtcgtgcagagcgagcaggccgagccgcccacgcaaccggccgaagcggcggattga

SEQ ID NO: 34 - protein, 341 aa, Unknown
  Obtained from an environmental sample
MLSPVTQYRAAAVQAAPSFLDLDRTVEKTIAIIEQAAEQDVRLIAFPETWIPGYPLWIWLGSPAWGMRFVQRYFENSLVRGSKQWNAIADAARRHRMTVVVGFSERAGGSLYMGQAIFGPEGELIAARRKLKPTHAERTVFGEGDGSHLAVYETGVGRIGALCCWEHIQPLSKYAMYAANEQVHVASWPCFSLYRGMAYALGPEVNTAASQVYAVEGGCYVLASCLVVTPEILKVLIDTPDKEPLLLAGGGFSMIFGPDGRALAQPLPETEEGLVTAEIDLGAIALAKAAADPAGHYARPDVTRLLLNPRPAARVEALGPRFEVVQSEQAEPPTQPAEAAD

SEQ ID NO: 35 - DNA, 942 bp, Unknown
  Obtained from an environmental sample
atgacagctctaaaaattgctgctgttcaaatgtgcgccgaattgggcgctacagatcgaaacctgagtgcagctggatcattcgtgcgcgacgcatttcgcgaaggtgcccagtgggtaatcctcccagagttttttacctcggcaatggcattcgcaccttcgatggcgcaagcttggttgccactggaaggaaaggcgctagcgatgatgcgcagccttgcgcgtcaattcgatggggttgttggaggctcatatgttgccagagaggggaacgactgcgtaaatgcctttcttctcgtctttccggatggaagctactaccggcatgacaaagatattccaacaatgtgggagaactgttactacatcggcggcgtcgacgatggggtgctggaaacaccaattggtgcggtgggagttgcactgtgttgggagttcatccgaacacaaaccgcccgaagactgaaggatcgcgttcaattagtggttggcggtacttgctggtgggattttccgatgcctgtacctgaacgatatctgaggctgaccaggcatatctccaggaactttgagcgcgatgctccggcgcggttggccagtatgttgggtgtgcctgttgtacacgcttcccatgctggggattttactgctgtcaccccaggcaatgaaacgaagaattaccgatccaactatctgggagagacccagatcgtcgatgccaatggaaatgtgttgaagcgaatgacagtggctgatggtgagggttacgtcattgctgacgttcaattgggggccatatcaaccggtcgaacttcgatccccgacaccttctggacctgcaagctaacgccaggggcacaacaggcttgggatgaacaaaatgcttttgggtgtggctactatgagaacgtcacacgcaaacacctaatcggtcgatga

SEQ ID NO: 36 - protein, 313 aa, Unknown
  Obtained from an environmental sample
MTALKIAAVQMCAELGATDRNLSAAGSFVRDAFREGAQWVILPEFFTSAMAFAPSMAQAWLPLEGKALAMMRSLARQFDGVVGGSYVAREGNDCVNAFLLVFPDGSYYRHDKDIPTMWENCYYIGGVDDGVLETPIGAVGVALCWEFIRTQTARRLKDRVQLVVGGTCWWDFPMPVPERYLRLTRHISRNFERDAPARLASMLGVPVVHASHAGDFTAVTPGNETKNYRSNYLGETQIVDANGNVLKRMTVADGEGYVIADVQLGAISTGRTSIPDTFWTCKLTPGAQQAWDEQNAFGCGYYENVTRKHLIGR

SEQ ID NO: 37 - DNA, 993 bp, Unknown
  Obtained from an environmental sample
atggattcagatatgacggatacttttaaggcagccattattcagcacgcgcctgtttttttaaatctcgaagagagtctggacaaagccggcagccttatagaaaaggctgccgatcaaggcgcgaaagtgatcgcctttcctgaaacatggctgcccggttatcccgtatggctcgactactctccaaaagcgggtctgtgggactatcagcctgcaaaatctctctatcgtctgctagtcgataattcagtcaccttacccggcaaacacctcgatcaactcctctccatagcgcaaaagaccggcgcatatgttgtaatgggggcacacgaacgagtgggtggaacactctataacacgacgatctatgttgggattgatgggaaggagtacaaacttcatagaaagctggtgccgacctataccgaaagattgatctgggggcggggagacggcagcacattgagtgtgttgatgacggattatggcgttcttggaggattgatctgctgggagcactggatgcctctggcaagagccgcaatgcatgccagatatgaaacccttcatgtggcgcaatggccggctgtaaaagatatccatcagatagcaagcagacattatgcttttgaaggccggtgtttcgtgctcgcggcaggctctgttctgactcgaagagatataatagaaggattcaactcactggctcgcgccgatagtgatgcattggaacttctgaaagctatttcgggagaagatagtgatcttattttgaatgggggaagcgcgataattgcgccgaatggagagtatcttgcgggcccggtctttaatgaaccctccattatttatgctgaaattgatcctgcactgataagtgagggccatcttacactggatacaagcggacactactcgcgccctgacatttttcgtctggagataaacgatcaacctcaacatgatgtaactttcagatcggggcattag

SEQ ID NO: 38 - protein, 330 aa, Unknown
  Obtained from an environmental sample
MDSDMTDTFKAAIIQHAPVFLNLEESLDKAGSLIEKAADQGAKVIAFPETWLPGYPVWLDYSPKAGLWDYQPAKSLYRLLVDNSVTLPGKHLDQLLSIAQKTGAYVVMGAHERVGGTLYNTTIYVGIDGKEYKLHRKLVPTYTERLIWGRGDGSTLSVLMTDYGVLGGLICWEHWMPLARAAMHARYETLHVAQWPAVKDIHQIASRHYAFEGRCFVLAAGSVLTRRDIIEGFNSLARADSDALELLKAISGEDSDLILNGGSAIIAPNGEYLAGPVFNEPSIIYAEIDPALISEGHLTLDTSGHYSRPDIFRLEINDQPQHDVTFRSGH

SEQ ID NO: 39 - DNA, 1008 bp, Unknown
  Obtained from an environmental sample
atgaaaaatatcaaaaactcagaaaaaagcagcacagtaagagtcgctgcggtacaaatcagtccggtgttgtacaaccgcgaagctaccgttcaaaaagtagtcaacaaaatccttgaactaggaaaacaaggggtacaattcgccacttttccggaaacgatagtgccttattatccttatttctcttttattcaggcgccttatgccatgggcaaagaacacctgcgcttgcttgaacaatcagttactgttccgtcagccgcgaccgatgccataagtgaggcggcaaaggaagccaatatggtagtgtctattggtgtcaatgaacgagacggtggtaccatttacaatacgcaactcctttttgatgctgacggaacattaattcagcgcagacgtaaacttacaccaacgtatcatgaaagaatgatttggggacaaggtgacgcttcaggtcttcgtgccacagacagcgctgttgggcgtatcgggcagttggcttgttgggaacattacaatccattgttccgttatgctttgattgctgatggagaacaaatccattctgccatgtatcccggatcatttttaggtgcgttgcacggtgaacaaaccgaaatcaatgtacgccaacacgctttagaatcggccagcttcgtcgtagtggctaccggttggttggatgccgatcaacaagcacaaattgcgaaagacaccggtggaccaatcggaccaatttcgggaggttgttttacagccgttataggccctgacggacaactaatcggggaagcccttacatcaggtgaaggggaagtgattgccgatattgatttggcacaaattgatgcccgcaaaagattaatggatgccagtggtcactacaaccgtcctgaattgttgagcttgcatatcgatcacactccgactgctcctatgcatgaaagagtagtttacactgagccgggattagcaaaaagacaaaatgaaaattcatcaaattaa

SEQ ID NO: 40 - protein, 335 aa, Unknown
  Obtained from an environmental sample
MKNIKNSEKSSTVRVAAVQISPVLYNREATVQKVVNKILELGKQGVQFATFPETIVPYYPYFSFIQAPYAMGKEHLRLLEQSVTVPSAATDAISEAAKEANMVVSIGVNERDGGTIYNTQLLFDADGTLIQRRRKLTPTYHERMIWGQGDASGLRATDSAVGRIGQLACWEHYNPLFRYALIADGEQIHSAMYPGSFLGALHGEQTEINVRQHALESASFVVVATGWLDADQQAQIAKDTGGPIGPISGGCFTAVIGPDGQLIGEALTSGEGEVIADIDLAQIDARKRLMDASGHYNRPELLSLHIDHTPTAPMHERVVYTEPGLAKRQNENSSN

SEQ ID NO: 41 - DNA, 966 bp, Unknown
  Obtained from an environmental sample
atgcccaatgagaataacatcgctacattcaaagttgccgcagtccaggccacaccggtgtttcttgatcgtgaagcaaccatcgacaaagcttgcgggttgattgccactgccggcaatgaaggagcgcgcctgattgtgtttccagaagcgttcatcccaacctatcctgaatgggtttggggtattccttccggtgagcaaggtttactcaatgaactctatgcagagctgctcaccaatgcggtcactattcccagtgacgcgactgacaggctgtgcgaggccgcgcagcttgcgaatgcctacgtagtgatgggaatgagcgaacggaatgtcgaggcgagtggcgcaagcctatataatacgctgttgtacatcaatgcgcagggggagattttagggaaacatcgaaagctggtgccaacgggcggcgaacgcctggtatgggcgcagggtgatggcagcacgctgcaggtctacgatacgccattgggaaaactcggtggtctcatttgctgggaaaattatatgccgctggcacgctatgctatgtatgcctgggggacacaaatctatgtcgcggcaacgtgggatcgaggccaaccctggctttctacattacggcatatcgccaaagaaggcagggtatacgtgattggttgctgtatcgcgatgcgaaaagacgatattccggatagttactccatgaagcagaaataccatgctgaaatggatgaatggattaatgttggcgacagtgtgattgtcaatcccgaaggacactttatcgcagggcctgtgcgcaagcaagaagaaattctctacgcggagatcgatccacgtatggtgcaaggcccgaagtggatgctcgatgtggcggggcattatgcgagaccagatgtgttccagttgacggtgcatacgaatgtgagagagatgatgcgggtggaagatgattcataa

SEQ ID NO: 42 - protein, 321 aa, Unknown
  Obtained from an environmental sample
MPNENNIATFKVAAVQATPVFLDREATIDKACGLIATAGNEGARLIVFPEAFIPTYPEWVWGIPSGEQGLLNELYAELLTNAVTIPSDATDRLCEAAQLANAYVVMGMSERNVEASGASLYNTLLYINAQGEILGKHRKLVPTGGERLVWAQGDGSTLQVYDTPLGKLGGLICWENYMPLARYAMYAWGTQIYVAATWDRGQPWLSTLRHIAKEGRVYVIGCCIAMRKDDIPDSYSMKQKYHAEMDEWINVGDSVIVNPEGHFIAGPVRKQEEILYAEIDPRMVQGPKWMLDVAGHYARPDVFQLTVHTNVREMMRVEDDS

SEQ ID NO: 43 - DNA, 993 bp, Unknown
  Obtained from an environmental sample
atgagagtcgttaaagccgcggcggtccaactgaaacctgtcctctatagccgagagggaactgtcgaaaacgtcgtccgtaaaatccacgagcttggacagcaaggggtacagttcgcgacgtttccagagactgtggtgccttactacccgtacttttcgatcgtgcagtccggctatcaaattcttggcggtggtgagttcctgaagctgcttgatcagtcagtaaccgtgccatctctcgctacggaagcgatcggcgaggcttgcaggcaggcgggcgtcgttgtctccatcggcgtcaacgagcgtgatggaggaactctatacaacacgcaacttctctttgatgccgacggaacattgattcaaagacgacgcaagatcacacccacccattacgagcgcatggtctggggccagggcgatggctcaggtttacgggccattgacagcaaggtcgcgcgcattggtcaactggcgtgttttgagcactacaaccctctcgcacgttacgcgatgatggccgatggcgagcagatccattctgcgatgttccccggctccatgttcggcgataatttttcagagaaggtggaaatcaacataaggcagcatgcaatggagtctgggtgctttgtcgtttgcgctactgcctggttggatgctgaccagcaggctcaaatcatgaaagacacgggatgtgagatcggaccgatctcaggaggttgcttcacagcgatcgcggcaccagatggaagccttataggtgaacccatccgctcaggtgaaggcgtttgtattgccgacctcgatttcaaacttatcgacaagcggaagcacgtagtagacacacgcggccattatagccggccagaattgctcagcctcctgattgatcggacgccgacggcccacatacacgaaaggaccgagcaaccgagggcggccatcgagaaagagtcgcaggatgttttcaccgctgttgcttaa

SEQ ID NO: 44 - protein, 330 aa, Unknown
  Obtained from an environmental sample
MRVVKAAAVQLKPVLYSREGTVENVVRKIHELGQQGVQFATFPETVVPYYPYFSIVQSGYQILGGGEFLKLLDQSVTVPSLATEAIGEACRQAGVVVSIGVNERDGGTLYNTQLLFDADGTLIQRRRKITPTHYERMVWGQGDGSGLRAIDSKVARIGQLACFEHYNPLARYAMMADGEQIHSAMFPGSMFGDNFSEKVEINIRQHAMESGCFVVCATAWLDADQQAQIMKDTGCEIGPISGGCFTAIAAPDGSLIGEPIRSGEGVCIADLDFKLIDKRKHVVDTRGHYSRPELLSLLIDRTPTAHIHERTEQPRAAIEKESQDVFTAVA

SEQ ID NO: 45 - DNA, 996 bp, Unknown
  Obtained from an environmental sample
gtgaaaccgccgacgtcattccgcgtggccgccgttcaggcctgtcccgtctacctcgatcgcgacctgacgatcggcaaggcagaagggttgatcgccgaggcggctggaaacggcgcgaacctcatcgtgttccccgaagcgttcgtgcctggctatccggtgtgggtgtggttcatcccgcccggtcgcacggcggatcttcgcgaagcgtacagcgtcctccacgccaactcgatcgcggtccccagccagtcgaccgagcgtctgtgcgcggcggcgcggcgcgctggcgtcgccgtggcgattggtgtcaacgaaagaaacagcgaggccagcggcggcagcctcttcaacacgctgctgtacatcggaccggacggcacgctgctcggtaaacaccgaaagctggtgccaacaggcggagagcgtcttgtctgggccagcggcgacggcagcgaccttgccgtgttcacactgcctttcgcgcgagtcggcggactgatctgctgggagaactacatgccgctcgcccgctacgcgctggcggcctggggtgcgcaaatccacgtggcgccgacctgggaccgcggcgagccgtggctctcaacactgcgtcatgtcgcgaaggaaggtagagccgtgacgatcggctgctgtcaggccgtccgcaaggaagacattccggacgggctggcattcaagtcccgatacctggccgacgtgggcgcctgggtcaacccaggcgggagcgtcatcgtcgatcccgacggaaaaattcttgccggacctgcgaacgaaaccgaaggcatcttgtacgctgacatcagggccgatcagctcgtcgggccgagatggcaactcgacattgccggacactacgcgcggccggacgtcttcgagctgatcgtgcatcggcgttcgacgccgatgattcgcgaggtctcggcgcctcgtcgtcgcgcaagaacgggaaagcgaccgcgacgccgctga

SEQ ID NO: 46 - protein, 331 aa, Unknown
  Obtained from an environmental sample
VKPPTSFRVAAVQACPVYLDRDLTIGKAEGLIAEAAGNGANLIVFPEAFVPGYPVWVWFIPPGRTADLREAYSVLHANSIAVPSQSTERLCAAARRAGVAVAIGVNERNSEASGGSLFNTLLYIGPDGTLLGKHRKLVPTGGERLVWASGDGSDLAVFTLPFARVGGLICWENYMPLARYALAAWGAQIHVAPTWDRGEPWLSTLRHVAKEGRAVTIGCCQAVRKEDIPDGLAFKSRYLADVGAWVNPGGSVIVDPDGKILAGPANETEGILYADIRADQLVGPRWQLDIAGHYARPDVFELIVHRRSTPMIREVSAPRRRARTGKRPRRR

SEQ ID NO: 47 - DNA, 1014 bp, Unknown
  Obtained from an environmental sample
gtgaaagaagcaatcaaagtagcctgtgtgcaagcagctccagtctttctcgacctggacgccacagtggacaagaccgtcgccctgattgaggaggcagcccgtaacggcgcacgcctaatcgcctttccagagacctggattccaggctacccatggttcctttggctggactcaccagcctgggggatgcaattcgtgcgccgataccacgagaactcactggtcctcgacagccctcaggccaagcgcatcagtgaggccgcccagcgcgccggtatatacgtcgcgctagggtacagcgaacgcgtgagcggaaccctctacatggggcagtggctcattgacgataagggcgaaacagctgggctgcgccgaaagctgaaaccaacccatgtagagcgaaccctcttcggtgaaggcgacggatcatccctttccactttcgacacaccgttgggggtgctgggcggactctgctgttgggaacacttacaacctctttcgaaatatgcgctctacgcacagaacgaggaaatacacttcgccgcctggcctagcttcagcatctaccgtcaagcgacagaagtccttggaccagaagtaaatgtcgcagcttctcggatctacgccgtggaagggcagtgttttgttctcgcttcctgcgcgctcgtctcgccagagatgatcgaaatgctctgcactgacgaaagcaagcacagccttcttcaggccggcggcgggtactcccgcattatcggtcccgatggcagcgacctagcgcgccccttgggcgaaaacgaggaaggtattctctatgccactctggaccctgccgctcgaatctatgcaaagaccgcagctgatccagccgggcactactccagaccagacgtcactcggctgctgatcaatcgcagtgccaatcagccagtcgtagaggttggaagggaaatacctgcatcggcccaaggctttgaagttgaggcggcccccgggtacgaaggcgattga

SEQ ID NO: 48 - protein, 337 aa, Unknown
  Obtained from an environmental sample
VKEAIKVACVQAAPVFLDLDATVDKTVALIEEAARNGARLIAFPETWIPGYPWFLWLDSPAWGMQFVRRYHENSLVLDSPQAKRISEAAQRAGIYVALGYSERVSGTLYMGQWLIDDKGETAGLRRKLKPTHVERTLFGEGDGSSLSTFDTPLGVLGGLCCWEHLQPLSKYALYAQNEEIHFAAWPSFSIYRQATEVLGPEVNVAASRIYAVEGQCFVLASCALVSPEMIEMLCTDESKHSLLQAGGGYSRIIGPDGSDLARPLGENEEGILYATLDPAARIYAKTAADPAGHYSRPDVTRLLINRSANQPVVEVGREIPASAQGFEVEAAPGYEGD

SEQ ID NO: 49 - DNA, 1038 bp, Unknown
  Obtained from an environmental sample
atgaacaaagtcgtggctgctgccgttcagtgcagcccggtgctttactcttgcgccggaactgtaaataaaatttgcgagtggattgcagatttgggcaaacaaggggttgagctggcggtgttcgcggaaaccctggtgccttactacccgtatttttcttttatccaggctccttgtgcgatgggcgcgcaacatttgttgttgatgcaagaatcagtagaggttccttccatctacacgcaacaaattgccgctgcagcaaaagcagcgaagatggtggtgtcagttggtattaacgaacgcgacggcggttctatttataacgcgcaattattatttgatgcgggcggtcagcttgttcagcaccgccgaaaaattacgccgacatttcatgagcgcatggtgtgggggcagggcgatggctccggtttgtgcgcagtggatacggcagttggtcgtgttggttcgctcgcttgctgggaacattacaacccactcgcgcgttacgcattgatggcagatcgcgaacaaattcacgtgagtatgtttcccggttctttggtcggcgaaatttttgccgagcaaattgaagcaactattcgtcaccacgcattggagtccggttgctttgtggtaaatgcgacgggctggttaacgccggaacagcaagctcaaatcgtaaaagatactggtggtcctatcgctgccattagcggtggttgtttcaccgccattgtttcaccggaaggaaaattgctcggcacgccattgcgcagtgattccggggagggtgcctgtatcgccgaactggattttaatctcatcaataagcgtaagcgcatgatggattctgtcggccattacagtcgtcctgaattgctcagtttgctgattgataaaacaccgacaagtcatacacatccgcttaaaaaacctttggctcccagtgaaaaaaatacgccagaggatatcgccactggtttaacactggtcactcccgtttcaaatgcaaaccttttcagcgcaagcaactag

SEQ ID NO: 50 - protein, 345 aa, Unknown
  Obtained from an environmental sample
MNKVVAAAVQCSPVLYSCAGTVNKICEWIADLGKQGVELAVFAETLVPYYPYFSFIQAPCAMGAQHLLLMQESVEVPSIYTQQIAAAAKAAKMVVSVGINERDGGSIYNAQLLFDAGGQLVQHRRKITPTFHERMVWGQGDGSGLCAVDTAVGRVGSLACWEHYNPLARYALMADREQIHVSMFPGSLVGEIFAEQIEATIRHHALESGCFVVNATGWLTPEQQAQIVKDTGGPIAAISGGCFTAIVSPEGKLLGTPLRSDSGEGACIAELDFNLINKRKRMMDSVGHYSRPELLSLLIDKTPTSHTHPLKKPLAPSEKNTPEDIATGLTLVTPVSNANLFSASN

SEQ ID NO: 51 - DNA, 897 bp, Unknown
  Obtained from an environmental sample
gtgaacgtccgcgtcgcggtggtgcaggccacgccggccgtgctcgacgggccggcgtcggtgcggaaggcctgccgcctgatcggcgaggccgcggccggcggcgcccgcctgatcgccctgcccgagggcttcgtgcccatcatgccgcgctcctgctgggggcaccacttcgcgctgatcgcctcgccgaagtcggcggccctgcaccggcgcatctgggagaacgccgtcgacgtcggcggcccgctggcccgcgagctcggcgacgccgcgcgccgcgcggacgcctgggtggccatcggggtgaacgagcgcgacgcccgccggccgggcacgctctggaacacgctgctctggttcgcgcccgacgggagcctggcccggcgccaccgcaagctcgtgcccaccatgcacgagcgcacgttctgggggcagggcgcgggcgacgacctcgaggcgctggccgcggacttcggccgcctgggcggcctgatctgctgggagaacttcatgcccgccgcgcgccggcgcctgcaccgggacggggtcgacttctacctggcccccacggcggacgaccgggacatctgggtcgccgcgatgcgcacgttcgccttcgaggccggcgccttcgtcctctcgccggtgcagtacctgcggaccgccgacttcccggaggacttcccgctgcgcgaggagctcgccgactgccccgaggtccagttcaccggggggagcgtgatctgcgacccgtggggcaacctcctggcggggccggtccacgggggcgaggagatcctctacgccgactgcgatctcgacctcgtcctcgaggcccgacgggtgctcgacacggccggccactacgaccgcccggacctcgcctcggcctga

SEQ ID NO: 52 - protein, 298 aa, Unknown
  Obtained from an environmental sample
VNVRVAVVQATPAVLDGPASVRKACRLIGEAAAGGARLIALPEGFVPIMPRSCWGHHFALIASPKSAALHRRIWENAVDVGGPLARELGDAARRADAWVAIGVNERDARRPGTLWNTLLWFAPDGSLARRHRKLVPTMHERTFWGQGAGDDLEALAADFGRLGGLICWENFMPAARRRLHRDGVDFYLAPTADDRDIWVAAMRTFAFEAGAFVLSPVQYLRTADFPEDFPLREELADCPEVQFTGGSVICDPWGNLLAGPVHGGEEILYADCDLDLVLEARRVLDTAGHYDRPDLASA

SEQ ID NO: 53 - DNA, 954 bp, Unknown
  Obtained from an environmental sample
atggtcaattcaaagagtcagattaaaatcgcggcggtgcaggctgccccggtctttctggaacgggaggcgacgattgacaaagcttgccggttgattgcggaggcaggcgagcagggcgcgaatctggtggtcttccctgagtcattcgtcccggcttatcccgattgggtctgggccgttccggcaggtgaaacaacgctcctgaacacgctctatgccgaactgctggccaatgccgttgaaattccgggtccggcgacagagcggctgagccaggcagccaacctggccggggtttatgtcgcgattggcttgaccgagcggaacatcgaggccagtggggcgagcctgtacaatactttgctctttctcgactcagccggcggcatgttaggcaagcatcgcaaactgatccccaccggcggcgagcgcctggtctgggctcagggtgatggcagcactctggcggtgtacgagactaggtttggaaaaatgggagggttgatttgctgggagaattacatgcccctggcccgttatgccttgtatgcctgggggacgcagatttacatcgcggccacctgggatcgaggcgagccgtggctgtcaacgctgcggcatatcgccgcggaaggccgggttgttgtcgtcggctgtggcatggccctgcgcaaagccgacctgcccgaccgctttgaactcaagcagcgattttaccagaacgccgatgagtggatcaatgtcggcgacagcgcgattgttaaccctgatggtgaattcatcgccgggccgctgcgcgagcaggaaggcatcctctatgctgagattgatctggcccagatgcgcggccccaaatggatgctcgacgtggccggccattacgctcgcccggatgtgtttgaactcatcgttcatcgggaggcgcggcccatgattgcgctaatttcatga

SEQ ID NO: 54 - protein, 317 aa, Unknown
  Obtained from an environmental sample
MVNSKSQIKIAAVQAAPVFLEREATIDKACRLIAEAGEQGANLVVFPESFVPAYPDWVWAVPAGETTLLNTLYAELLANAVEIPGPATERLSQAANLAGVYVAIGLTERNIEASGASLYNTLLFLDSAGGMLGKHRKLIPTGGERLVWAQGDGSTLAVYETRFGKMGGLICWENYMPLARYALYAWGTQIYIAATWDRGEPWLSTLRHIAAEGRVVVVGCGMALRKADLPDRFELKQRFYQNADEWINVGDSAIVNPDGEFIAGPLREQEGILYAEIDLAQMRGPKWMLDVAGHYARPDVFELIVHREARPMIALIS

SEQ ID NO: 55 - DNA, 1017 bp, Unknown
  Obtained from an environmental sample
atgggtatcgaacatccgaagtacaaggtcgccgtggtgcaggcagctcccgcctggctcgatctcgacgcgtcgatcgacaagtcgatcgcgctgatcgaggaggcggcccaaaaaggcgccaagctgatcgcattccccgaggccttcattcccggctatccctggcacatctggatggactcgccggcctgggcgatcggccgcggctttgtgcagcgctattttgacaattcgctcgcctatgacagcccgcaggccgagaagctgcgcgcggcggtgcgcaaggcaaagctcaccgccgtgctcgggctgtccgagcgcgacggcggcagtctctatctggcgcaatggttgatcgggcccgatggcgagaccatcgcaaaacgccgcaagctgcggccgacacatgccgagcgcacggtgtacggcgagggcgacggcagcgatctcgcagtccacaaccgtcccgatatcggccgcctcggcgcgctctgctgctgggagcatttgcagccactgtcgaaatacgcgatgtacgcgcagaacgagcaggtgcatgtcgcggcctggccgagcttttcgctctacgatccctttgcggtggcgctcggcgccgaggtgaacaacgcggcctcgcgcgtctatgcagtcgaaggctcctgcttcgtgctggcgccatgcgccaccgtctcgcaggccatgatcgacgagctctgcgaccgaccggacaagcatacgctgctgcatgtcggcggcggttttgccgcgatctatggtcctgacggcagccagatcggcgacaagctcgcgcccgaccaggaagggctgttgatcgcggagatcgaccttggggccattggcgtcgccaagaacgcggccgatcccgccgggcattattcgcggcccgacgtgacgcggctcctgctcaacaagaaaccgtacaagcgcgtcgagcagttctcgccaccggccgaggcggtcgagcccacagatatcgcagcggcggcaagctga

SEQ ID NO: 56 - protein, 338 aa, Unknown
  Obtained from an environmental sample
MGIEHPKYKVAVVQAAPAWLDLDASIDKSIALIEEAAQKGAKLIAFPEAFIPGYPWHIWMDSPAWAIGRGFVQRYFDNSLAYDSPQAEKLRAAVRKAKLTAVLGLSERDGGSLYLAQWLIGPDGETIAKRRKLRPTHAERTVYGEGDGSDLAVHNRPDIGRLGALCCWEHLQPLSKYAMYAQNEQVHVAAWPSFSLYDPFAVALGAEVNNAASRVYAVEGSCFVLAPCATVSQAMIDELCDRPDKHTLLHVGGGFAAIYGPDGSQIGDKLAPDQEGLLIAEIDLGAIGVAKNAADPAGHYSRPDVTRLLLNKKPYKRVEQFSPPAEAVEPTDIAAAAS

SEQ ID NO: 57 - DNA, 1014 bp, Unknown
  Obtained from an environmental sample
gtgaaagaagcaatcaaagtagcctgtgtgcaagcagctccagtctttctcgacctggacgccacagtggacaagaccgtcgccctgattgaggaggcagcccgtaacggcgcacgcctaatcgcctttccagagacctggattccaggctacccatggttcctttggctggactcaccagcctgggggatgcaattcgtgcgccgataccacgagaactcactggtcctcgacagccctcaggccaagcgcatcagtgaggccgcccagcgcgccggtatatacgtcgcgctagggtacagcgaacgcgtgagcggaaccctctacatggggcagtggctcattgacgataagggcgaaacagctgggctgcgccgaaagctgaaaccaacccatgtagagcgaaccctcttcggtgaaggcgacggatcatccctttccactttcgacacaccgttgggggtgctgggcggactctgctgttgggaacacttacaacctctttcgaaatatgcgctctacgcacagaacgaggaaatacacttcgccgcctggcctagcttcagcatctaccgtcaagcgacagaagtccttggaccagaagtaaatgtcgcagcttctcggatctacgccgtggaagggcagtgttttgttctcgcttcctgcgcgctcgtctcgccagagatgatcgaaatgctctgcactgacgaaagcaagcacagccttcttcaggccggcggcgggtactcccgcattatcggtcccgatggcagcgacctagcgcgccccttgggcgaaaacgaggaaggtattctctatgccactctggaccctgccgctcgaatctatgcaaagaccgcagctgatccagccgggcactactccagaccagacgtcactcggctgctgatcaatcgcagtgccaatcagccagtcgtagaggttggacgggaaatacctgcatcggcccaaggctttgaagttgaggcggcccccgggtacggaggcgattga

SEQ ID NO: 58 - protein, 337 aa, Unknown
  Obtained from an environmental sample
VKEAIKVACVQAAPVFLDLDATVDKTVALIEEAARNGARLIAFPETWIPGYPWFLWLDSPAWGMQFVRRYHENSLVLDSPQAKRISEAAQRAGIYVALGYSERVSGTLYMGQWLIDDKGETAGLRRKLKPTHVERTLFGEGDGSSLSTFDTPLGVLGGLCCWEHLQPLSKYALYAQNEEIHFAAWPSFSIYRQATEVLGPEVNVAASRIYAVEGQCFVLASCALVSPEMIEMLCTDESKHSLLQAGGGYSRIIGPDGSDLARPLGENEEGILYATLDPAARIYAKTAADPAGHYSRPDVTRLLINRSANQPVVEVGREIPASAQGFEVEAAPGYGGD

SEQ ID NO: 59 - DNA, 987 bp, Unknown
  Obtained from an environmental sample
atgcgagataggaatttcaaactggcggccattcaggcggagccggttttctttaatcgccgggcctcgacggaaaaggcctgcagattgatcaaagaagcgggcgcgatgggcgccgatatcgcgggattcagcgagacctggcttcccgggtatcccttttttatctggggcgcaagcgccgatccatccctgctctggaaggcttctgcggaatacctggccaatgccgttcaaatacccggtcccgagacggatcaattatgcgaggcggcgaaaaaggccggcatcgatgtggcgatcggagtggttgaactcgacgagtttacgaagggaacggcttactgcacgctgctcttcatcggcaaagaagggaagatcctgggaaagcaccgcaaactcaagccgacgcaccgggagcgcacggtatggggagagggcgatgcgacgggactcagtgtccatgagcgtccttacgggcggatcagcggcctgaactgctgggagcataatatggtcctgcccggctatgtcctgatgtctcagggcacgcacattcatatcgcggcctggccgggttcggaagggaaagcacctcccgcgccgtctccgatgtgggagcgccagcttctgctctcccgcgctttcgcttcgcaatccgccgcatacgtgattctggtcggaggactcctgaacccgcagaatattccggcgccctacgatgaacttgccgtcaagtaccggggagacagtttcatcatcgatccgcgcggggagatcatcgccgggccggccaagggggaaaccattctcatcgccgaaggctcgatggaacaggtcctcgcggcaaagtccgccttcgatgtcgcgggacattattcccgccccgacgtctttcaactctgcgtcaaccgcaaaccgtaccggcgtgtaagggaaacttcggagcaggaccaacccgcttctgaaagagaatcggaatcgtaa

SEQ ID NO: 60 - protein, 328 aa, Unknown
  Obtained from an environmental sample
MRDRNFKLAAIQAEPVFFNRRASTEKACRLIKEAGAMGADIAGFSETWLPGYPFFIWGASADPSLLWKASAEYLANAVQIPGPETDQLCEAAKKAGIDVAIGVVELDEFTKGTAYCTLLFIGKEGKILGKHRKLKPTHRERTVWGEGDATGLSVHERPYGRISGLNCWEHNMVLPGYVLMSQGTHIHIAAWPGSEGKAPPAPSPMWERQLLLSRAFASQSAAYVILVGGLLNPQNIPAPYDELAVKYRGDSFIIDPRGEIIAGPAKGETILIAEGSMEQVLAAKSAFDVAGHYSRPDVFQLCVNRKPYRRVRETSEQDQPASERESES

SEQ ID NO: 61 - DNA, 966 bp, Unknown
  Obtained from an environmental sample
atgactcgatcttacccgaatgacacactcacggttgggcttgcgcaaattgctccagtctggttggatcgtacagggacaatttcaaagatattagctcaagtccatgcggcaaatgaagcgggctgtcatcttgtcgcgtttggcgaaggtctcctccccggatatccgttttggattgagcgaacaaatggtgcagtcttcaactcgcccacgcagaaagaaattcacgcgcattatctggatcaggctgtccagatcgaagcaggtcatcttgaggcgctttgcgaagcagccaaggaatatgagatcgcaattgtcctgggatgcattgaacgtccgcaagatcgtggagggcacagtctgtatgcaagccttgtatatattgattcagacggcatcatccaatctgtgcatcgaaagttaatgccaacatatgaagaacggctcacctggtcgccaggtgacggacatggattacgggtgcacaaattaggtgcctttacggttggcggcctcaactgttgggaaaactggatgcctttggcacgcgcggccatgtatggtcaaggcgaggatttgcatattgccatttggcccggcggctcccacaatacgcaagacattacacgctttattgcactagaatcgcgttcctatgttttatctgtgtcaggtttaatgcgctcaggcgattttccaaaagagaccccacatcttgcatccatcctggctaaaggtgaggatattcttgccaacggtggttcatgtatcgccggtcctgacggcaaatggatcgttgagccgcttgtaggagaagagaagttaattgttgcaacgattgatcattgtcgtgtgcgcgaagagcgtcaaaattttgatccttcaggacattacagcaggccagatgtattgcaactgaaaataaacaggcaacgccagagtacaatctcgtttggagagtaa

SEQ ID NO: 62 - protein, 321 aa, Unknown
  Obtained from an environmental sample
MTRSYPNDTLTVGLAQIAPVWLDRTGTISKILAQVHAANEAGCHLVAFGEGLLPGYPFWIERTNGAVFNSPTQKEIHAHYLDQAVQIEAGHLEALCEAAKEYEIAIVLGCIERPQDRGGHSLYASLVYIDSDGIIQSVHRKLMPTYEERLTWSPGDGHGLRVHKLGAFTVGGLNCWENWMPLARAAMYGQGEDLHIAIWPGGSHNTQDITRFIALESRSYVLSVSGLMRSGDFPKETPHLASILAKGEDILANGGSCIAGPDGKWIVEPLVGEEKLIVATIDHCRVREERQNFDPSGHYSRPDVLQLKINRQRQSTISFGE

SEQ ID NO: 63 - DNA, 978 bp, Unknown
  Obtained from an environmental sample
atgcaagatagagtaccgattgtacgagctgcggctatccaggctgaacccatagtccttgattgtgacgcgaccgtggaaaaagcctgccgattgatcggtgaagcagcagaaaatggtgcaaacctgatcgtgtttcccgaagccttcattcccgtttatcccaatgcggcgatctggggtcgaggtctggccacttttggcggacagcgccagaaatacgtatggacgcgactatggaacaattcggtggaaatccctggtccggccaccgacaggctggcaaaggcagcacacgaggctcgagccaccgttgtcatgggattgaatgagcgcgcggtcgataacaacacgctttacaacaccctgctatttattgggccagacggtcgcttgctgggcaagcaccgtaagctcatgcccaccaatcacgaacggatgatctggggtatgggagatgggagcaccctgcgggtttttgatacaccctgtggaaaagtaggcggtctcatctgctgggaaaactacatgcctctggcgcgttatgcactctatggacagggcgaacaaatccatgtcgcgccgactgcgcacgatggtgagatcactctggtcaatgcacgcaataccgcctatgagggacgcttattcgtcatctccgtgtgcatgatccttcgcaagtccagctttccccatgattttgagctgggcgaggaattggcggaggcagatgacttcataaaatcaggcggcagcgcgatcgttgggccagatggcgaggtgctggcgggtccattgtggaatgaagagaatatactgtatgccgatcttgacttgaatcgaattgtggatgagagacgagtatttgatgtgacgggccattattcacgtccagatgttctacgactgcactttaatgcttcccctcagaaaactattgaaagatatgagcaacctctcgatccgtctgagggttaa

SEQ ID NO: 64 - protein, 325 aa, Unknown
  Obtained from an environmental sample
MQDRVPIVRAAAIQAEPIVLDCDATVEKACRLIGEAAENGANLIVFPEAFIPVYPNAAIWGRGLATFGGQRQKYVWTRLWNNSVEIPGPATDRLAKAAHEARATVVMGLNERAVDNNTLYNTLLFIGPDGRLLGKHRKLMPTNHERMIWGMGDGSTLRVFDTPCGKVGGLICWENYMPLARYALYGQGEQIHVAPTAHDGEITLVNARNTAYEGRLFVISVCMILRKSSFPHDFELGEELAEADDFIKSGGSAIVGPDGEVLAGPLWNEENILYADLDLNRIVDERRVFDVTGHYSRPDVLRLHFNASPQKTIERYEQPLDPSEG

SEQ ID NO: 65 - DNA, 1002 bp, Unknown
  Obtained from an environmental sample
atgccgacccccacttcaaaattcaaaatcggcgccgtgcaggcatcgccggtttttctggaccgggaagccactgcgcaaaaagcctgcaaattgattgccgaagcgggagggcagggcgcgcggctgatcgttttcccggagtctttcattcccacctatcctgattgggtctgggcggtcccgccgggaagaggaaaagtgttaagcgaactttacgccgagctgctggccaatgccgtggaagtccccgggccggtcaccgatcagctgggtgaagcagcccaaaaaacgggcgcctatgtcgtcatgggcgtcacggaaaaggacaccgacgcaagcggcgcgagcctttacaacacgctcctctatttcaaccccgcgggggacctcctgggaaaacaccggaagcttgttcctaccggcggggagcggctggtctgggcgcagggcgacggcagcaccctggaagtgtacgacactcccctgggaaaaatcggaggcctcatctgctgggaaaactacatgcccctcgcccggtacacgatgtatgcctgggggacccagatttatatcgcggccacatgggaccagggggagacgtggcttgccaccctgcggcatatcgctaaggaaggacgggtgtacgtcatcggctgctgcatcgcgctgcggcgggacgacatccccgaccggctggaatacaagaagaagttctactcggggtcgcgggaatggatcaatatgggggacagcgccatcgtgaacccggaaggcgaattcattgccggccccgtgcggatgaaggaggagatcctgtatgccgaggtggaccccctcctgatggcgggatcgaaatggatgctcgacgtcgcggggcattacgcgcgccccgacgtctttgaactcatcgtccaccgccagccccacccgatgatccgggtaatcgagaaagagggaggggccggaagaaccggggacgagaagaaggaaaatgagtga

SEQ ID NO: 66 - protein, 333 aa, Unknown
  Obtained from an environmental sample
MPTPTSKFKIGAVQASPVFLDREATAQKACKLIAEAGGQGARLIVFPESFIPTYPDWVWAVPPGRGKVLSELYAELLANAVEVPGPVTDQLGEAAQKTGAYVVMGVTEKDTDASGASLYNTLLYFNPAGDLLGKHRKLVPTGGERLVWAQGDGSTLEVYDTPLGKIGGLICWENYMPLARYTMYAWGTQIYIAATWDQGETWLATLRHIAKEGRVYVIGCCIALRRDDIPDRLEYKKKFYSGSREWINMGDSAIVNPEGEFIAGPVRMKEEILYAEVDPLLMAGSKWMLDVAGHYARPDVFELIVHRQPHPMIRVIEKEGGAGRTGDEKKENE

SEQ ID NO: 67 - DNA, 936 bp, Unknown
  Obtained from an environmental sample
atgccccgtgtggcggtggtccagcgcccgccggtgtttctcgaccgcgccgcgaccctcgagaacgccgtggcttcgctcgccgaggccgcgtcgaacggggctcgcctcgcggtctttccggaagccctggttcccggctatccggcgtggatgtggcggctgcggcccgggcccgacatggcgctcaccgagcggattcacgcgcgcttgcgggcgaactcggtgagcctcgccgccgacgagctcgcgccgctgcgcgaggcggcccggcgccacgagctcaccgtagtgtgcggcctgcacgagcgcgacgaggcgctcggcggcggcacgctctataacaccgtcgtcacgatcggcgccgacggcgcggtgctcaaccgccaccggaagctgatgcccaccaaccccgagcgcatggtctggggctgcggcgatgccagcgggctcaggacggtccccacccagtgcgggcgcgtcggcgccctgatctgctgggaaagctacatgccgcttgcacgctacgcgctgtacgcccagggaatcgacctctacgtcacgccgacctacgacagcggcgagcgggcggttgcgaccatgcagcacattgcccgcgaaggcggctgctgggtggtgagctgcggctcggcgtttcaggcgcgcgacgtcccggacgcgtttccggggaagagcgagcttttccgcgacaacgacgagtggatcaacccgggcgactcggtcgtggtcgcgccgggcggcaaggtcgtcgccgggccgctgcacaaagaacgcgcgatcctgtacgccgagatcgacctcgagcgggtcggcgtggcgcgccgcagcctggacgtggtcggccattatgcgcggcccgacctcttcgacctgcacgtgaacgcccgcccgcaaagcgtggttgaattgcgctga

SEQ ID NO: 68 - protein, 311 aa, Unknown
  Obtained from an environmental sample
MPRVAVVQRPPVFLDRAATLENAVASLAEAASNGARLAVFPEALVPGYPAWMWRLRPGPDMALTERIHARLRANSVSLAADELAPLREAARRHELTVVCGLHERDEALGGGTLYNTVVTIGADGAVLNRHRKLMPTNPERMVWGCGDASGLRTVPTQCGRVGALICWESYMPLARYALYAQGIDLYVTPTYDSGERAVATMQHIAREGGCWVVSCGSAFQARDVPDAFPGKSELFRDNDEWINPGDSVVVAPGGKVVAGPLHKERAILYAEIDLERVGVARRSLDVVGHYARPDLFDLHVNARPQSVVELR

SEQ ID NO: 69 - DNA, 939 bp, Unknown
  Obtained from an environmental sample
gtgaccgagtttcggacggtgcgggtcgcagcggtgcaggcgacgccggtgaccctcgacgccgatgcctcggtcgagaaggcgatcgggctgatcggcgaggcggtggccggtggagcgcagctcgtcgtgctgcccgaggccttcgtgtcgctctacccgtcgaacgcgtgggcgcgagcggccgccggattcggcggcttcgacgagctctgggagcggatgtgggccagctcgctcgacgtcccgggcccgctggtcgaccggctggtcgatgcgtgccgcaggcatgacgtggtatgcgtgatcggcgtgaacgagcgcgaaagcgaaaggccggggtcgctttacaacacgatgctgaccctcggcccgtcgggcctcctgcaccggcaccgcaagctcatgccgacgcaccacgagcggctgttccatgggatcggcgacggtcaagacctcggcgttgtggagaccgacgcgggacggatcgggggactgatctgctgggagaaccgaatgccgctcgcgcgctacgcggtctaccagggtggaccgcagatctgggtcgcgccgacggccgatgactccgacggctggctcgcgagcatgcgccacatcgcgatcgagtcgggcgcgttcgtcgtgtcggtgccgcagttcatcccggcgtccgcgttccccgacgatttccccgtcgagctaccgccgggcaaggaggtgttcggccgcggcggtgcggcgatcgtcgagccgacctggggcgaggtaatcgccgggccgctctacgatcgggaggggatcgtgttcgccgactgtgacctgcgacgcggcttgcatgccaagcgctggttcgactccgtcggccattacagccgcgcggaggtgctcgatggcggcgtcgagcgcgtcccggcgccggtggacggcgaatcgccgtga

SEQ ID NO: 70 - protein, 312 aa, Unknown
  Obtained from an environmental sample
VTEFRTVRVAAVQATPVTLDADASVEKAIGLIGEAVAGGAQLVVLPEAFVSLYPSNAWARAAAGFGGFDELWERMWASSLDVPGPLVDRLVDACRRHDVVCVIGVNERESERPGSLYNTMLTLGPSGLLHRHRKLMPTHHERLFHGIGDGQDLGVVETDAGRIGGLICWENRMPLARYAVYQGGPQIWVAPTADDSDGWLASMRHIAIESGAFVVSVPQFIPASAFPDDFPVELPPGKEVFGRGGAAIVEPTWGEVIAGPLYDREGIVFADCDLRRGLHAKRWFDSVGHYSRAEVLDGGVERVPAPVDGESP

SEQ ID NO: 71 - DNA, 966 bp, Unknown
  Obtained from an environmental sample
atgccaaacgagaacaccaacgccacattcaaagttgccgctgtgcaggcttcgcctgtgtttcttgatcgtgccgcaacaatcgacaaggcttgcgatttgatcgccgctgctggcggtgaaggggcacgcttgattgtctttccagaagcattcatcccgtcttatcctgattgggtatgggcaattccttcgggtgaagagggcgtactcaatgagttgtacgcagatctgctatccaactcggtcacgattcccagtgactcgacggacaaactgtgcagagcagccaggcttgctaatgcctacgtggtgatgggtatgagcgaacgcaatgctgaggcaagcggcgcgagcatgtataacacgctattgtatattgatgcacagggggagattctgggcaagcatcggaagttggtgccaacgggcggcgagcggctagtctgggcgcagggcgatggcagtacactgcaggtctatgatactcccttagggaaactcggtggcttaatttgctgggagaattatatgccactggcccgctataccatgtatgcctggggcacacaaatctatgtcgcggcaacgtgggatcggggtcagccctggctctctactttacgccacattgccaaagaaggcagggtgtatgtgattggttgttgtatcgcgatgcgtaaagacgatatcccagaccattatacaatgaaacagaagttttactcagatgcagatgagtggattaatattggcgatagtgcgattgttaatcccgaagggcaatttatcgctggaccggtgcgcaagcaggaagagattctctatgcggagattgatccgcgcatggtccaagggccgaagtggatgctcgacgtggcgggacattatgccaggccggatgtgttcgaactgattgtccacacggatattcgaaggatgatcaaatcggaaaagaattcataa

SEQ ID NO: 72 - protein, 321 aa, Unknown
  Obtained from an environmental sample
MPNENTNATFKVAAVQASPVFLDRAATIDKACDLIAAAGGEGARLIVFPEAFIPSYPDWVWAIPSGEEGVLNELYADLLSNSVTIPSDSTDKLCRAARLANAYVVMGMSERNAEASGASMYNTLLYIDAQGEILGKHRKLVPTGGERLVWAQGDGSTLQVYDTPLGKLGGLICWENYMPLARYTMYAWGTQIYVAATWDRGQPWLSTLRHIAKEGRVYVIGCCIAMRKDDIPDHYTMKQKFYSDADEWINIGDSAIVNPEGQFIAGPVRKQEEILYAEIDPRMVQGPKWMLDVAGHYARPDVFELIVHTDIRRMIKSEKNS

SEQ ID NO: 73 - DNA, 1035 bp, Unknown
  Obtained from an environmental sample
atgacagcaatagactcaacgtttaaagtcgccgccgttcaggctgcgccggtcttcctcaatcgcgacgcaaccgtggagaaggcgtgccggctgatcaagtccgcggcagagggaggcgcgcgtctgatcgttttcccggaagcgttcataccggcctacccggactgggtgtggacggtccctgccggtgagcaaggcctgctcaacgacctctacggccaactcgtcgaccagtccgtgacgattcccagcgacatcaccaccgagttatgtaacgcggcacgggcagcaaacgcctatgtcgtgattggtgtcaacgagcgcaacgcggaggcaagcaatggaagcctctacaactcgctcctctacatcgacgcaaacggcaaaattctcggtaagcaccgcaagctcgttcccacaggcggagaacggctcgtgtgggcgcagggcgatggcagcacgctcgaagcctacgacacggagctgggcaaactcggcggtctcatttgctgggagaactatatgccgctggcacgctacgcgatgtacgcatggggagtgcagctctatgtcgccgcgacctgggaccgtggcggcccctggactgccacgctgcgtcatgtcgccaaggaaggtcagatgtacgtcatcgggtgctgccaggccctgcacaaggatgacctgccggagctagacgggctgaaggagaagtactacgccaacgcacgagagtggatcaatgttggcgacagcgctattgtcggcccggacggacaattccttgtcgagcccgtccgaatgcgggaagacatcctctacgccgaggtggacactcgcaacttccgcggcccgaagtggatgttcgacgcggctggacactacgcgcgtcccgacattttccaactcacagtgaaccgcgagcagcggccgatggtccgcgtcgtcggtgacagcagtgaccagaaggagcggccgctcccggacgacggacggctctggtacgcctacagcaccaatcagcaccacgactga

SEQ ID NO: 74 - protein, 344 aa, Unknown
  Obtained from an environmental sample
MTAIDSTFKVAAVQAAPVFLNRDATVEKACRLIKSAAEGGARLIVFPEAFIPAYPDWVWTVPAGEQGLLNDLYGQLVDQSVTIPSDITTELCNAARAANAYVVIGVNERNAEASNGSLYNSLLYIDANGKILGKHRKLVPTGGERLVWAQGDGSTLEAYDTELGKLGGLICWENYMPLARYAMYAWGVQLYVAATWDRGGPWTATLRHVAKEGQMYVIGCCQALHKDDLPELDGLKEKYYANAREWINVGDSAIVGPDGQFLVEPVRMREDILYAEVDTRNFRGPKWMFDAAGHYARPDIFQLTVNREQRPMVRVVGDSSDQKERPLPDDGRLWYAYSTNQHHD

SEQ ID NO: 75 - DNA, 1125 bp, Unknown
  Obtained from an environmental sample
atgagcaccattgttaaagccgctgcggttcaaatcagcccagtcctctacagccgcgaggggacagtcgcaaaagttgtgcggaagatccacgaacttggccaaaagggggtgcggttcgccacgttcccggagaccgtggttccctactatccatatttttccgccgtccagacccccattcaactattgtccggaaccgagtacctgaagttgctcgaccaaggcgtgaccgtgccgtccacgactaccgacgcaatcggggaggctgcccggaacgccggcatggttgtatctatcggcgtgaatgagcgtgacggcgggaccctgtacaacgcgcagttgctcttcgatgcggatgggaccttgattcagcgtcgccgcaagatcactcctacgcattacgagcgcatgatctggggccagggagatggttcgggtttgcgggccgtcaagagccaggttggtcgtattggccaacttgcatgctttgagcacaacaacccactggcgcgttacgcgatgatggccgatggcgagcaaatccattcggccatgtatccaggttccgcgttcggcgaggggttcgcggaaaagatggaaatcaatatccgccagcatgcgttggagtccgggtgcttcgttgtgaatgcaacggcctggcttgacgccagccagcaggcacaaatcatgaatgacacgggttgccaaatcggtccgatctcgggcggttgctttaccacgatcgtaacacccgacggcacgtttctgggcgaacctctccggtcgggtgagggcgaggtcatcgccgatctcgatttcaagctgatcgacaaacgcaagatgttgatggactcgcgcggccactacagtcgcccggaattgctcagtctgctgatcgaccgcacccccaccgcgcacattcatgagcgaggtgcgccgcagacgtcaggcgctgtgcaagaggcgacgaaagtgggttcacacgcgccgctcctgcgtgacggacaatgggatcagctcaatgcgggagcgggccgacatacagggaatggagaagcacagatagaaatcatggccgcggcccactcgggcacccgtggaattgaagcgaagggagcctaa

SEQ ID NO: 76 - protein, 374 aa, Unknown
  Obtained from an environmental sample
MSTIVKAAAVQISPVLYSREGTVAKVVRKIHELGQKGVRFATFPETVVPYYPYFSAVQTPIQLLSGTEYLKLLDQGVTVPSTTTDAIGEAARNAGMVVSIGVNERDGGTLYNAQLLFDADGTLIQRRRKITPTHYERMIWGQGDGSGLRAVKSQVGRIGQLACFEHNNPLARYAMMADGEQIHSAMYPGSAFGEGFAEKMEINIRQHALESGCFVVNATAWLDASQQAQIMNDTGCQIGPISGGCFTTIVTPDGTFLGEPLRSGEGEVIADLDFKLIDKRKMLMDSRGHYSRPELLSLLIDRTPTAHIHERGAPQTSGAVQEATKVGSHAPLLRDGQWDQLNAGAGRHTGNGEAQIEIMAAAHSGTRGIEAKGA

SEQ ID NO: 77 - DNA, 1056 bp, Unknown
  Obtained from an environmental sample
atgccaacccccagcgatcatttcaaaatcgccgctgttcaggcctcgcccgtgtttctggaccgggaggccactgtggaaaaggcctgccggttgatcgccgaagccgcaaagcagggcgtccgcctcatcgtctttccggaatcgttcatcccgacctacccggactgggtatgggccgttcccccgggaagggaaagaatcctgaaccagctgtattctgaattcctggccaatgccgtcgatgttcccggcgcggcgaccgaacaacttgcccaggctgcacgaatggccggcgcctatgtgattatgggcgtcaccgaaagagacacctcggccagcggggccagcctctacaacaccctgctctacttcagccccgaaggcatcctaatgggcaaacaccggaagctggttcccacggggggcgaacggctggtctgggcctacggagacggcagcacgctggaggtctacgacactccgctgggaaagatcggcgggctgatctgctgggagaactacatgcccctggcccggtacacgatgtacgcctggggcacccagatttacatcgccgccacctgggaccgcggggaaccgtggctctccaccctgcggcatatcgcaaaggaaggaagggtctacgtcatcgggtgctgcatcgccctgcgccagggggatatcccggaccggttcgagtacaagggaaaattttattccgggtcccgggagtggatcaatgagggcgacagcgccatcgtgaacccggacggggaattcatcgccgggccggtgcggacgaaggaggagatcctgtatgccgagatagacccccggcagatgcggggccccaagtggatgctcgatgtggccggtcattacgcccggccggatatcttcgagctcatcgtccaccggaatccccacccgatgatcaaaatcgccgaagacaggggcacggggatcgcctcaagtttgattcgcccccgccctaaccttcccccatcaagggggaggaaatcggcaagaagcaaacgcaagcccaaaaaatga

SEQ ID NO: 78 - protein, 351 aa, Unknown
  Obtained from an environmental sample
MPTPSDHFKIAAVQASPVFLDREATVEKACRLIAEAAKQGVRLIVFPESFIPTYPDWVWAVPPGRERILNQLYSEFLANAVDVPGAATEQLAQAARMAGAYVIMGVTERDTSASGASLYNTLLYFSPEGILMGKHRKLVPTGGERLVWAYGDGSTLEVYDTPLGKIGGLICWENYMPLARYTMYAWGTQIYIAATWDRGEPWLSTLRHIAKEGRVYVIGCCIALRQGDIPDRFEYKGKFYSGSREWINEGDSAIVNPDGEFIAGPVRTKEEILYAEIDPRQMRGPKWMLDVAGHYARPDIFELIVHRNPHPMIKIAEDRGTGIASSLIRPRPNLPPSRGRKSARSKRKPKK

SEQ ID NO: 79 - DNA, 990 bp, Unknown
  Obtained from an environmental sample
atgacgaagaaaagcggccgcgattcgtttcgggtcgctgcggtccaggcctcgtccgtctacctggatcgggaacggagcatcgagaaagcgtgccggctgatcgacgacgcgggacgaaacgacgccgacctcgtcgtgttccccgaagccttcgtgcccggatacccactgtgggtgtggctcgttccgccggggcgcaccgcagacttgcgctccgcttatgcgacgctccacgccaacgcgatcagcattccggacgactccaccgatcggctgtgcgccgccgcaaaagacgccggcgtcgccgtcgcgatcggcgtcaacgaacgcaacaccgaagcgagcggcatgagcctgttcaacacgctgctctatatcggagcggacggccggattctcggaaaacaccggaagctggtaccgaccggcggcgaacggctcgtctgggcatctggcgacggcagcgacctcgaggtctactcgctgccgttcggtcgcgtaagcggactgatctgctgggagcactacatgccgctcgcccggtatgcgctcgccgcgtggggcgaacaggtgcacgtcgctccaacctgggatcgtggcgagccgtggctgtccacgctaaggcacatcgcgaaggaaggccgcgttctcgtcgtcggctgctgtcaagccgtgcgcaaggacgacatccctgacacgctcgcgttcaagtccaaatacctcgcagacgtggacggctggatcaacccaggtggcagcgtcatcatcaatcctgacggcaaggtcgtcgcgggaccggcgatggaaaccgaaactgtactgtacgcggaccttcgcaccgagcagctcgtcggaccgcgctggcagctcgacgtcggcggacattacgctcgtccggacgtcttcgagctcgtcgtccatcggcatccgaagccgttgattcggacagcgaccggtgtcaggcgccgcaagcgtgcacgtcgctaa

SEQ ID NO: 80 - protein, 329 aa, Unknown
  Obtained from an environmental sample
MTKKSGRDSFRVAAVQASSVYLDRERSIEKACRLIDDAGRNDADLVVFPEAFVPGYPLWVWLVPPGRTADLRSAYATLHANAISIPDDSTDRLCAAAKDAGVAVAIGVNERNTEASGMSLFNTLLYIGADGRILGKHRKLVPTGGERLVWASGDGSDLEVYSLPFGRVSGLICWEHYMPLARYALAAWGEQVHVAPTWDRGEPWLSTLRHIAKEGRVLVVGCCQAVRKDDIPDTLAFKSKYLADVDGWINPGGSVIINPDGKVVAGPAMETETVLYADLRTEQLVGPRWQLDVGGHYARPDVFELVVHRHPKPLIRTATGVRRRKRARR

SEQ ID NO: 81 - DNA, 993 bp, Unknown
  Obtained from an environmental sample
atgaaagtcgtcaaagccgccgctgtccagttcagcccggtgctctatagccgcgaagcgaccgtcgccaaggtcgtccggaaaatccacgagctcggtcagaaaggcgtgcagttcgccacctttcctgaaacggtcgtgccttattacccttacttcgcggccgtccagacgggcatcgagctcttgtcgggcaccgaacatctgcgcctgctcgaacaggccgtgactgtgccctccgctgcgaccgatgcaatcggcgaagccgcgcgacaggccggcatggtcgtgtccatcggcgtcaatgagcgtgacggcggcacgctttacaacacgcaactgctcttcgatgccgacggtacgctgatccagcgccgccgcaagatcacgccgacccatttcgaacgcatgatctgggggcagggagatggctcgggcttgcgtgcagtcgacagcgcagtcggccgcatcggccagctcgcatgcttcgagcacaacaacccgcttgcacgttacgcaatgatcgccgacggcgagcagatccattcagcgatgtaccctggctcggcctttggcgagggcttcgcccagcgtatggagatcaacatccgccagcatgcgctcgagtccgccgctttcgtcgtcaacgcaacggcgtggcttgacgccgaccagcaggcgcaaatcatgaaggacaccggttgtggaatcggtccgatctcgggcggctgcttcaccacgatcgtttctcctgacggtatgctgatggccgatccgcttcgctcgggcgaaggcgaagtgattgtcgatctcgacttcacgcagatcgaccgccgcaagatgctgatggactcggccggccactacaaccgccctgaactgctgagtctgatgatcgaccgtacgccggctgcgcatgttcacgaacgcgcttcgcgcccgatgaccgtcgacgaccagagttccggcgatctgcgcacccaggttgcatga

SEQ ID NO: 82 - protein, 330 aa, Unknown
  Obtained from an environmental sample
MKVVKAAAVQFSPVLYSREATVAKVVRKIHELGQKGVQFATFPETVVPYYPYFAAVQTGIELLSGTEHLRLLEQAVTVPSAATDAIGEAARQAGMVVSIGVNERDGGTLYNTQLLFDADGTLIQRRRKITPTHFERMIWGQGDGSGLRAVDSAVGRIGQLACFEHNNPLARYAMIADGEQIHSAMYPGSAFGEGFAQRMEINIRQHALESAAFVVNATAWLDADQQAQIMKDTGCGIGPISGGCFTTIVSPDGMLMADPLRSGEGEVIVDLDFTQIDRRKMLMDSAGHYNRPELLSLMIDRTPAAHVHERASRPMTVDDQSSGDLRTQVA

SEQ ID NO: 83 - DNA, 1071 bp, Unknown
  Obtained from an environmental sample
atgatgagttcagcccgtgtaataaaactcgccgcagcacagctttcacctgtgctgccgggggagtccacaaatagccgcgacggcaccattgccaaagtcgtcgcggcgattgcggaggctgcgcgcgccggcgcgcagctgatcgtgtttcccgaaacggtggtgccgtattacccgtatttctcgttcattacgccggcggtgacgatgggggcggagcatttgcgcttgtacgatcagtctgtcgtggtgccgagcgccgccactgatactgttgccgccgctgcaaaaaaacacagcatggtggtcgtgctcggtattaacgaacgcgatcacggcacgctctacaacgcgcaattaattttcgatgcgagcggcgaattattattaaaacgccgaaaaattaccccgacctatcacgagcgcatggtgtggggtcagggcgacggcagcggtttgaaaaccgtcgacaccgcgatcggccgtgtcggtgcgctcgcctgctgggaacattacaacccattggcgcgttacagcctgatggcccagcacgaagaaattcattgcagtcaatttccggggtcattggtcgggccaattttcgccgagcaaatggaagtgacaatgcgccaccacgcgctcgaatccggttgcttcgtcgttaatgcaacggcgtggttatcggaagcgcaaattcaatcgatcagcagcgatcccgcgatgcaaaaagcactgcgcggcggttgctacaccgcaattatttcgcccgaaggcaaacatctgtgcgagccgctacgcgaaggtgaaggtttgatttttgccgaagccgatatggcgctcattaccaaacgcaaacgcatgatggattcggttggtcattacgcgcgacccgaattgctgtcgctgttaatcgaccatcgcgccaccacaccattgcatagcgtcaccgcgagtgatgccgccgccgtaaaaaatactcggagttccgctcatgaatcagccgatagtgaaaccatccgcgagtcagttaataacggaactccaatcgcacggcttgcgcctagttga

SEQ ID NO: 84 - protein, 356 aa, Unknown
  Obtained from an environmental sample
MMSSARVIKLAAAQLSPVLPGESTNSRDGTIAKVVAAIAEAARAGAQLIVFPETVVPYYPYFSFITPAVTMGAEHLRLYDQSVVVPSAATDTVAAAAKKHSMVVVLGINERDHGTLYNAQLIFDASGELLLKRRKITPTYHERMVWGQGDGSGLKTVDTAIGRVGALACWEHYNPLARYSLMAQHEEIHCSQFPGSLVGPIFAEQMEVTMRHHALESGCFVVNATAWLSEAQIQSISSDPAMQKALRGGCYTAIISPEGKHLCEPLREGEGLIFAEADMALITKRKRMMDSVGHYARPELLSLLIDHRATTPLHSVTASDAAAVKNTRSSAHESADSETIRESVNNGTPIARLAPS

SEQ ID NO: 85 - DNA, 1014 bp, Unknown
  Obtained from an environmental sample
atgggtctggttcatcagaaatacaaggttgcggtggttcaggcggcgccggtctttctcgacctcgatgcgacggtggacaagacgatcgccctgatcgagcaggccgcagcacagggcgcgaagctgatcgcgtttcccgagaccttcattcccggatatccgtggcagatctggcttggggcgcccgcctgggcgatcggccgtggcttcgtgcagcgctatttcgataactcgttgtcatttgacagcccgcaggccgaaaaaattcgcaaggccgtcaagcgcgccaagctgaccgcggtgatcggcgtctccgaacgcgacggcggcagcctctatatcggccaatggctgatcggtcccgacggcgagaccattgcgaagcgccgcaagctgcggccgacccatgccgaacgcaccgtgttcggcgagggcgacggcagcgacctcgccgtccatgatcgcgccgacgtgggacggctcggtgcaatgtgctgctgggagcatctgcagccgctgtcgaaatacgcgatgtacgcccagaacgagcaggttcacgtcggcgcctggccgagcttctcattgtacgacccattcgcccatgcgcttggctgggaagtaaacaacgcggcgagcaaggtttatgctgtcgagggctcatgtttcttcctcggcccgtgcgcggtggtctcgcaggccatgatcgacgagctctgcgattcccccgaaaagcacgccttcctgcacgctggcggcggccacgcggtaatctatgggccggacgggagttcgcttgccgacaaacttccacccgatcaggagggcattctgtatgccgatatcgatctcggcatgatcggcgtggcaaagaacgccgccgaccccgcaggacactattccaggccggacgtcacgcggctgctgctcaacacttcccgcgccaatcgcgtcgagcatttttcattgccgatcgatgccgaggtcatgagcgaaatcagacttcaggcctga

SEQ ID NO: 86 - protein, 337 aa, Unknown
  Obtained from an environmental sample
MGLVHQKYKVAVVQAAPVFLDLDATVDKTIALIEQAAAQGAKLIAFPETFIPGYPWQIWLGAPAWAIGRGFVQRYFDNSLSFDSPQAEKIRKAVKRAKLTAVIGVSERDGGSLYIGQWLIGPDGETIAKRRKLRPTHAERTVFGEGDGSDLAVHDRADVGRLGAMCCWEHLQPLSKYAMYAQNEQVHVGAWPSFSLYDPFAHALGWEVNNAASKVYAVEGSCFFLGPCAVVSQAMIDELCDSPEKHAFLHAGGGHAVIYGPDGSSLADKLPPDQEGILYADIDLGMIGVAKNAADPAGHYSRPDVTRLLLNTSRANRVEHFSLPIDAEVMSEIRLQA

SEQ ID NO: 87 - DNA, 1062 bp, Unknown
  Obtained from an environmental sample
atggcggaatcgaagctgaaggtcgccgcaattcaagttgcgcccgtgttcatggatcgcgatgccacgatcgcccgcgcctgcgagcggatcgccgaagccgcccgcgccggcgcggagttggtggtctttcccgaggcattcgtgcccgggtatcccgactggatctgggtggcgcggccaagccaacgcaaactgctcaatgatctttacgcgcacctcgtctcgcagtcggtcgacgtgccgtcggcctccgtggatcgtttgcgcgacgcggctcgcgacggcggggtcacggtggtgatcggcgtcaacgagcgcaacaccgaagcgagcggcgcgagcctctacaacaccgcgctcgtgatcggtccactggggcagctgatcggccgccaccgcaagcttgtgccgaccgggccggagcgcatggtgtgggcgcagggcgacggcagcacgctcgacgtctacgacacacccgtcggcaagctttcgacgttgatctgctgggagaactacatgccgctcgcgcgctacgccatggcggcgtggggcgcgcgcatccacgtcgccggcacgtgggaccgcggcgagccgtggatctcgaccatgcgtcatgtggcgacggagggccgcgtattcgtgattagctgttgcatggcgctgcgcaaacgagacattcccgccgagctcgagttcgcgatgctctatcccgacgggcgcgaatggatcaacgccggtgattcgctggtcgtgaatcccgctggccagatcatcgctgggccgttgcacgagcaggaaggaatcctctacgccgagctcgagcgcaatcagatgaccggtccgcgttggatgttcgacgccgccggccattacgcgcgaccggacgtcttccaactcacggtaaaccgctccccgcgcccgatgctgcgggaggcgggggcaaagacgagtgaggcaaacacgagagatgccgtacccatggacagcacgccctcgagatcgcggccccgcgcggtggcgcgaaaggccgcacgcaccggtcgctccaagcggcggtga

SEQ ID NO: 88 - protein, 353 aa, Unknown
  Obtained from an environmental sample
MAESKLKVAAIQVAPVFMDRDATIARACERIAEAARAGAELVVFPEAFVPGYPDWIWVARPSQRKLLNDLYAHLVSQSVDVPSASVDRLRDAARDGGVTVVIGVNERNTEASGASLYNTALVIGPLGQLIGRHRKLVPTGPERMVWAQGDGSTLDVYDTPVGKLSTLICWENYMPLARYAMAAWGARIHVAGTWDRGEPWISTMRHVATEGRVFVISCCMALRKRDIPAELEFAMLYPDGREWINAGDSLVVNPAGQIIAGPLHEQEGILYAELERNQMTGPRWMFDAAGHYARPDVFQLTVNRSPRPMLREAGAKTSEANTRDAVPMDSTPSRSRPRAVARKAARTGRSKRR

SEQ ID NO: 89 - DNA, 918 bp, Unknown
  Obtained from an environmental sample
atgaataccaaagaagtaaaggtcgcagccgctcaatttgccccacattttctgaatttgagcaaaacggtggaaaaaacctgcaacttgatttccgaagcaggcaaaaatggagcaaagctcattgtatttccggaagccttcctctctggttatcccgattgggtctggttaattcccaatggaaattcaacaatgctggatgatttatatcaggaattggttgagaacgctgtaacaatccctgattcaacaacacagaaactctgtcaggcagcaaaagatgccggggtatatgtcgcagtcggtatccatgaaagaaatgcagaagcaagtggcttcacacttttcaatacccttctatacattaatgatcaaggcagcatcattggaaaacaccgaaaactgatcccaacagggggcgaacgcctggtctgggggcagggtaatggggatacgcttgctgcattcgatacacactttggcaaattgggaggattgctttgctgggaaaactacatgcccctggctcggcaagctatgtacgcagttgggactgaagtttatgttgccccaacctgggactccagtgagaattggttgctgagtatgcgccatatagccagagagggcggcatgtttgtgatcaatgtttgccaggctgtccgaaaagacgatattcctgaccgctatgcattcaagcaactctattctggtaattcagaatggatcaatagcggcaacagttgcatcatcaatccgcgcggtgaaatcattgccggaccatcctcaaacaggcaagaaatactctacgcagatttagatctgagtttgattacaaaatctaaacgcatgttcgatgttaccgggcattatgcccggccggatgtgtttagatatgaaatcaaaaaaagctag

SEQ ID NO: 90 - protein, 305 aa, Unknown
  Obtained from an environmental sample
MNTKEVKVAAAQFAPHFLNLSKTVEKTCNLISEAGKNGAKLIVFPEAFLSGYPDWVWLIPNGNSTMLDDLYQELVENAVTIPDSTTQKLCQAAKDAGVYVAVGIHERNAEASGFTLFNTLLYINDQGSIIGKHRKLIPTGGERLVWGQGNGDTLAAFDTHFGKLGGLLCWENYMPLARQAMYAVGTEVYVAPTWDSSENWLLSMRHIAREGGMFVINVCQAVRKDDIPDRYAFKQLYSGNSEWINSGNSCIINPRGEIIAGPSSNRQEILYADLDLSLITKSKRMFDVTGHYARPDVFRYEIKKS

SEQ ID NO: 91 - DNA, 939 bp, Unknown
  Obtained from an environmental sample
atgaccaaaatcgctgtcattcaagaacctccggtctatctgaatctgagtaaatcgatggacagagcggtcgacttgattgccaatgctgcaagcaaggggtgtgagttgattgtgtttcccgaagcctggcttgcaggttaccccaccttcgtctggcgtcttgcgccgggcagcggaatgggaaaaactgatgagctttacgcgcgtttgctcgccaactcggtcgaccgtagcaaagaggggcttagaccattgcaggaggccgcaaaggagcatggcgttgtcattgtgctgggttatcaagaggtggatggcgcgggaagcagcagcacgatcttcaacagctgtgcgattattgatgcggacgggcgactggccaacaatcatcgcaagttgatgcccaccaatccggagaggatggtttggggttttggcgacggttcaggcctgaacgtcgttgacaccgcggtgggcaggatcggcacgctgatttgctgggaaaactacatgccgttagcgcgctacgcgctgtatgtccaaaacatcgaaatctatgttgccccgacttgggacagtggtgccatgtggcaggcgaccctgcagcatatcgcgcgcgaaggtggctgctgggtcatcggatgtgcaacgtcgctggaagcctctgacatcccggacgacgttccccatcgggatgagctattcccgaacaaagacgaatgggtaaaccctggcgatgcggtggtttataagccatttggcggcattgtggccggccccatgcatcaggaaaaggggcttctcatcgcagagttggacgtcgccgctgttcagtcgtcacgtcggaagttcgatgcgagcgggcactacgctcgccccgatgtcttcaaactgcatgtgaatcgcaccgcgatgcggccagttgatttcacgaattag

SEQ ID NO: 92 - protein, 312 aa, Unknown
  Obtained from an environmental sample
MTKIAVIQEPPVYLNLSKSMDRAVDLIANAASKGCELIVFPEAWLAGYPTFVWRLAPGSGMGKTDELYARLLANSVDRSKEGLRPLQEAAKEHGVVIVLGYQEVDGAGSSSTIFNSCAIIDADGRLANNHRKLMPTNPERMVWGFGDGSGLNVVDTAVGRIGTLICWENYMPLARYALYVQNIEIYVAPTWDSGAMWQATLQHIAREGGCWVIGCATSLEASDIPDDVPHRDELFPNKDEWVNPGDAVVYKPFGGIVAGPMHQEKGLLIAELDVAAVQSSRRKFDASGHYARPDVFKLHVNRTAMRPVDFTN

SEQ ID NO: 93 - DNA, 978 bp, Unknown
  Obtained from an environmental sample
atgcccatcatcaaagccgctgccgtgcaaatcagcccggtgctttacagtcgcgaaggcaccgtggacaaggtctgtcaacagatcatcgacctcggtcggcaaggcgtgcagttcgccgtctttccggaaacggtggtgccttactacccgtacttttcgtttgtgcagccggcctttgccatgggcgcacagcacctcaagttgctggatcaatcggtgacagtgccgtcggccgccaccttggccatcggtgaagcttgcaagcaagcagggatagtggtgtccatcggcgtcaacgaacgcgatggcggtacgatctacaacgcgcaattactcttcgatgccgacggcagcctgattcagcatcgccgcaaaatcaccccgacctatcacgaacgcatggtctgggggcaaggcgatggttccggcctgcgcgccatcgacagtgcagtggggcgcattggctccctggcctgttgggagcattacaacccgctggctcgttatgccttgatggccgatggcgagcagatccacgccgcgatgtttcccggctcgctggtgggcgacatttttgccgagcagatcgaagtcaccatccgccatcacgccttggagtccggctgtttcgtggtcaacgccaccgcctggctggacgccgatcagcagggccaaatcatgcaagacaccggttgcagcctcggcccgatctcgggtggctgcttcaccgccatcgtttcccctgaaggcaagttgctcggtgagccgctgcgttccggcgaaggggtggtgatcgccgatctcgatctggcactgatcgataagcgtaaacggatgatggattcggtcgggcattacagtcgcccggaactgctcagcctgttgatcgaccgcacgcccacagcgcatgtgcatgaacgcagcgcgcacctggtggctgtcgctaccgaggagttcgatcatgcaaaccaatga

SEQ ID NO: 94 - protein, 325 aa, Unknown
  Obtained from an environmental sample
MPIIKAAAVQISPVLYSREGTVDKVCQQIIDLGRQGVQFAVFPETVVPYYPYFSFVQPAFAMGAQHLKLLDQSVTVPSAATLAIGEACKQAGIVVSIGVNERDGGTIYNAQLLFDADGSLIQHRRKITPTYHERMVWGQGDGSGLRAIDSAVGRIGSLACWEHYNPLARYALMADGEQIHAAMFPGSLVGDIFAEQIEVTIRHHALESGCFVVNATAWLDADQQGQIMQDTGCSLGPISGGCFTAIVSPEGKLLGEPLRSGEGVVIADLDLALIDKRKRMMDSVGHYSRPELLSLLIDRTPTAHVHERSAHLVAVATEEFDHANQ

SEQ ID NO: 95 - DNA, 966 bp, Unknown
  Obtained from an environmental sample
atgtccaacgagaataacattgctacattcaaagttgccgcagtccaggccacacctgtgtttcttgatcgtgaagcaaccatcgacaaagcttgcgcgttgattgccactgctggcagtgaaggagcgcgcctgattgtgtttccagaagcattcatcccaacttatcctgaatgggtatggggtattccctccggtgagcaaggtttactcaacgaactctatgcagagttgctcaccaatgcggtcaccattcccagcgatgcgactgacaggctgtgcgaggctgcgcagcttgcgaatgcctacgtagtgatgggcatgagcgaacggaacgtcgaggcgagtggcgcaagcctgtataatacgctgttgtacataaatgcgcagggggagattttagggaaacatcgaaagctggtgccaacgggcggcgaacgcctggtatgggcgcagggtgatggcagtacgctgcaggtctacgatactccattgggaaaactcggtggcttaatttgctgggaaaattatatgccgctggcacggtatgctatgtatgcctggggaacacaaatctatgtcgcggcaacgtgggatcgcggtcaaccctggctttctacattaaggcatatcgccaaagaaggcagggtatacgtgattggttgctgtatcgcgatgcgtaaagacgatattccagatcgttacaccatgaagcaaaaatattatgctgaaatggatgaatggatgaatgttggtgacagtgtgattgtcaatcccgaggggcactttattgccgggcctgtgcgcaagcaggaagaaattctctacgcggagattgatcctcgcatggtgcaaggcccgaagtggatgctcgatgtggcagggcattatgcgagaccggatgtgttccagttgacggtgcatacggatgtgaggcggatgatgcgggtggaagatgattcataa

SEQ ID NO: 96 - protein, 321 aa, Unknown
  Obtained from an environmental sample
MSNENNIATFKVAAVQATPVFLDREATIDKACALIATAGSEGARLIVFPEAFIPTYPEWVWGIPSGEQGLLNELYAELLTNAVTIPSDATDRLCEAAQLANAYVVMGMSERNVEASGASLYNTLLYINAQGEILGKHRKLVPTGGERLVWAQGDGSTLQVYDTPLGKLGGLICWENYMPLARYAMYAWGTQIYVAATWDRGQPWLSTLRHIAKEGRVYVIGCCIAMRKDDIPDRYTMKQKYYAEMDEWMNVGDSVIVNPEGHFIAGPVRKQEEILYAEIDPRMVQGPKWMLDVAGHYARPDVFQLTVHTDVRRMMRVEDDS

SEQ ID NO: 97 - DNA, 1017 bp, Unknown
  Obtained from an environmental sample
atgggcatcgaacatccgaaatacaaggtcgccgtggtgcaagctgcgcccgcctggctcgacctcgacgcgtcgatcgacaagacgatcgggctgatcgaggaggcggcgaagaaaggcgccaagctgatcgctttccccgaagccttcattcccggctacccttggcacatctggctcgactcacccgcctgggcgatcggccgcggtttcgtgcagcgctatttcgacaattcgctcgcctacgacagcccacaggcggaaaggctgcgacaggccgtgcggaaggccaagctcaccgccgtgatcggcctgtccgagcgcgacggcggcagcctctatctcgcgcagtggctgatcgggcccgacggtgagaccatcgcaaagcgccgcaagctgcggccgacccatgccgagcgcaccgtctatggcgaaggcgacggcagcgatctcgccgtccatgagcgggccgacatcggccggctcggcgcgctgtgctgctgggagcatctgcagccgctgtcgaaattcgccatgtacgcccagaacgagcaggtacatgtcgcggcctggccgagcttctcgctctacgatcccttcgcgcctgcgctgggcgcggaggtgaacaacgccgcctcccgcatctatgcggtggaaggctcctgcttcgtgctcgcaccgtgcgcgacggtctcgcaggccatgatcgacgagctctgcgatcggccggacaagcacgcgctgctgcatgccggcggcggcttcgccgcgatctacgggcccgacggcagccagatcggcgacaagctgccgcccgagcaggagggcctgctgatcgccgagatcgatctgggcgcgatcggcgtcgccaagaacgcggccgatcccgccgggcattattcgcggcccgacgtcacgcggctcctgctcaacaggaagccgaacaagcgcgtggagcagttcgcgctgcccgtcgacacggtcgagcccgtcgacgtcgcggcggcagcaagctga

SEQ ID NO: 98 - protein, 338 aa, Unknown
  Obtained from an environmental sample
MGIEHPKYKVAVVQAAPAWLDLDASIDKTIGLIEEAAKKGAKLIAFPEAFIPGYPWHIWLDSPAWAIGRGFVQRYFDNSLAYDSPQAERLRQAVRKAKLTAVIGLSERDGGSLYLAQWLIGPDGETIAKRRKLRPTHAERTVYGEGDGSDLAVHERADIGRLGALCCWEHLQPLSKFAMYAQNEQVHVAAWPSFSLYDPFAPALGAEVNNAASRIYAVEGSCFVLAPCATVSQAMIDELCDRPDKHALLHAGGGFAAIYGPDGSQIGDKLPPEQEGLLIAEIDLGAIGVAKNAADPAGHYSRPDVTRLLLNRKPNKRVEQFALPVDTVEPVDVAAAAS

SEQ ID NO: 99 - DNA, 1014 bp, Unknown
  Obtained from an environmental sample
atgcctgacaagagaatcgtccgcgccgccgcggtccagatagcaccggacctcgaacggcccggtggcacgctcgagaaggtcctcgagacgatcgacgacgccgcacgccagggcgtgcagctcatcgtcttccccgagaccttcctgccctactacccgtacttttcgttcgtgcgggcgccggtggcatcgggtgcagagcacatgcggctctatgacgaagcggtggtcgtgcccgggccggtgacgcatgcggtggccgagcgggcacggcggcacggcatggtcgtcgtgctcggcgtgaacgagcgcgatcacggcagcttatacaacgcacaactgatcttcgataccgacggcgagctgctgctcaagcgccgcaagatcacgccgacgtttcacgaacggatgatctggggcatgggcgacgcagccggcctgaaggtagcggaaacgcgtatcggccgggtgggtgcactcgcttgctgggaacactacaacccgcttgcacgttatgcactgatgacccagcacgaagagattcattgcagccagtttcccggctcgctggtcggacccatcttcggtgaacagatcgaagtgaccatccggcatcacgcactggaatccggctgcttcgtgatcaattccaccggctggctgaccgagccgcagatcgagtcgatcacgaaagatccgggcctgcagaaggcgcttcgcggcggctgcaacacggcgatcatctcgcccgaaggccagcatctcgccccgccgctgcgtgagggcgagggcatggtcatcgctgacctggacatgtcgctgatcaccaaacgcaaacgcatgatggattctgtcggccactacgcgcggcccgaactgctgagcctcgccatcaacgaccggccggcggtcacgtcggcacccatgaacagcttctcatcttcaaccgggggattgcaccttgaacgcgaacgagaccttgtcggccgtgagccggcaattgatgactga

SEQ ID NO: 100 - protein, 337 aa, Unknown
  Obtained from an environmental sample
MPDKRIVRAAAVQIAPDLERPGGTLEKVLETIDDAARQGVQLIVFPETFLPYYPYFSFVRAPVASGAEHMRLYDEAVVVPGPVTHAVAERARRHGMVVVLGVNERDHGSLYNAQLIFDTDGELLLKRRKITPTFHERMIWGMGDAAGLKVAETRIGRVGALACWEHYNPLARYALMTQHEEIHCSQFPGSLVGPIFGEQIEVTIRHHALESGCFVINSTGWLTEPQIESITKDPGLQKALRGGCNTAIISPEGQHLAPPLREGEGMVIADLDMSLITKRKRMMDSVGHYARPELLSLAINDRPAVTSAPMNSFSSSTGGLHLERERDLVGREPAIDD

SEQ ID NO: 101 - DNA, 1065 bp, Unknown
  Obtained from an environmental sample
atggcgacagtccatccgaaatttaaagtagccgccgtccaggcggccccggcctttctcgacctcgacgcgtcggtggaaaaagcggtgcgcctgattgatgaagccggcgccgctggtgcccggctcatcgcgtttccagagacttttatccccggttatccgtggtggatctggctcggtgctccggcctgggcgatcatgcgcggcttcgtctcccgctatttcgacaactcgctgcagtacggcaccccggaagccgaccggctgcgggcagccgccaaacgcaacaaaatgttcgtcgcgctcggactgtcagagcgcgacggcggcagtctctacatcgcccaatggattatcggacccgacggcgagacggtcgcaacgcgccgcaagctcaagcctactcacgccgagcggacggtgttcggcgaaggcgatggctcgcaccttgcggtccacgaacttgatatcgggcgggtcggtgcgctgtgctgttgggagcacctgcagccactgtcgaagtacgcgatgtatgcgcagaacgagcaagttcatatcgcggcgtggccgagcttttcgctttacgatccgttcgcgcatgcgcttggcgccgaggtcaacaacgcggcgagcaagatctacgcggtcgaaggctcatgctttgtgattgcgccatgcgcgaccgtttcccaggcgatgatcgacgaattgtgtgactcgcccgagaagcatcagttcctgcacgtcggcggcggtttcgccgtgatctatggtcccgacggcgcgccactcgccaagccactggcgcccgatcaggagggtctcctttacgcggatatcgacctcggcatgatttcggtcgcgaaagcggcggccgatccggctggacattacgcgcgcccggacgtgacccgtctgttgttcaacaatcgtcctgggaaccgggtggagacactcgcgctgccggtcgaccaggaggcagaggcgggagcaggcggcaaacctgcgcccaagtcaccgagtgtcgctgcgttcacactgacgcaggcggcagccgagtag

SEQ ID NO: 102 - protein, 354 aa, Unknown
  Obtained from an environmental sample
MATVHPKFKVAAVQAAPAFLDLDASVEKAVRLIDEAGAAGARLIAFPETFIPGYPWWIWLGAPAWAIMRGFVSRYFDNSLQYGTPEADRLRAAAKRNKMFVALGLSERDGGSLYIAQWIIGPDGETVATRRKLKPTHAERTVFGEGDGSHLAVHELDIGRVGALCCWEHLQPLSKYAMYAQNEQVHIAAWPSFSLYDPFAHALGAEVNNAASKIYAVEGSCFVIAPCATVSQAMIDELCDSPEKHQFLHVGGGFAVIYGPDGAPLAKPLAPDQEGLLYADIDLGMISVAKAAADPAGHYARPDVTRLLFNNRPGNRVETLALPVDQEAEAGAGGKPAPKSPSVAAFTLTQAAAE

SEQ ID NO: 103 - DNA, 945 bp, Unknown
  Obtained from an environmental sample
atgggcgagttcggcgaggtgacgctgggggtggcgcaggcggcgccggtgtacttcgaccgggaggcgtcgacggagaaggctcgcggcctgatccgggaggcgggggagaagggcgtcgacctgttggcgttcggggagacgtggctgacggggtacccgtactggaaggatgcgccgtggtctcgggagtacaacgacctgcgcgcgcggtacgtggcgaatggcgtgatgataccggggccggagacggacgcgctatgccaggcagcggcggaagcgggggtggacgtggcaatcggcgtggtggagctggagccggggagcctttcgagcgtgtattgcacgttgctgttcatctcgcgcgagggcgagatcctggggcggcaccggaagctgaagccgacggattcggaacggcggtactggtcagagggtgatgcgacggggctgcgggtgtacgagcggccatatggccggttgagcggattgaactgctgggaacaccttatgatgttgccggggtacgcgctggcggcacaggggacgcagtttcatgtggcagcgtggccgaacatggcgagctcggcgagcgagctgctgtcgcgggcgtatgcgtaccaggccggatgctacgtgttgtgcgcgggcgggctcgggcctgcgccgggagagctaccggacggcatcgcggcggagtcgctggaccacctgacgggcgagagctgcatcatcgacccgtggggaaaagtgatcgcggggccggtgtcgtgcgaggagacgctgattacggcgcgggtatcgaccgcgtcaatctaccggcgcaagtcgctgacggacgtgggtggccactactcgcgaccggacgtgttccggttcgaggtggataggtcggagcgcccgcgagtggtgtttcgggatggggatgtggacgaccgggggtaa

SEQ ID NO: 104 - protein, 314 aa, Unknown
  Obtained from an environmental sample
MGEFGEVTLGVAQAAPVYFDREASTEKARGLIREAGEKGVDLLAFGETWLTGYPYWKDAPWSREYNDLRARYVANGVMIPGPETDALCQAAAEAGVDVAIGVVELEPGSLSSVYCTLLFISREGEILGRHRKLKPTDSERRYWSEGDATGLRVYERPYGRLSGLNCWEHLMMLPGYALAAQGTQFHVAAWPNMASSASELLSRAYAYQAGCYVLCAGGLGPAPGELPDGIAAESLDHLTGESCIIDPWGKVIAGPVSCEETLITARVSTASIYRRKSLTDVGGHYSRPDVFRFEVDRSERPRVVFRDGDVDDRG

SEQ ID NO: 105 - DNA, 975 bp, Unknown
  Obtained from an environmental sample
atgaccattgtcaaagccgctgccgtccagattgcccccgttctctacagccgtgaaggcactgtagaaaaggtcgttaacaagattcgcgaactcggcgagaagggcgtgcagttcgccgttttccctgaaaccgtcgtaccgtactacccgtacttttcctttgtgcagagccctttcaaaatgggttccgagcactacaaattgctcgaccaggccgttgtcgtgccgtcggcgaccaccgatgccatcggcaaagcggccaaggaagccaacatggtggtgtccatcggcgtcaacgaacgcgatggcagcaccctctacaacacgcagttgctgtttgatgccgacggcactttgattcaggcccgtcgcaagatttcaccgacctaccacgaacgcatgatctggggcatgggcgacggttccggcctgcgcgccaccgacagcgcggtcgggcgcatcggacaattggcctgctgggaacattacaatccgctggcgcgttacgccttgatcgaagacggcgaacagatccacgcctcgatgtacccgggctcgttcgcaggtcctttattcactcgccagatggaagtcagcatccgcatgcatgccctggaatcggcgtgcttcgtggtcaactcgaccgcgtggttgtacccggaacagcaagcccagatcatggccgacaccggttgcgagatcgggccgatctccggcggctgctacaccgcgatcatcgacccacagggtgaagtcgtcggcgcactgaccgaaggcgagggcgaagtgattgccgacatcgatctgttccagatcgaaatccgtaaacgtcagatggacggccgtggtcactacagccgtccggaaatcctgagcctgaacatcgaccgtacgccgcatcgccatgttcacgaacgcaacgaccagcagaaaccgggtgtgatcgacactgctgaagaaaccgggcgttga

SEQ ID NO: 106 - protein, 324 aa, Unknown
  Obtained from an environmental sample
MTIVKAAAVQIAPVLYSREGTVEKVVNKIRELGEKGVQFAVFPETVVPYYPYFSFVQSPFKMGSEHYKLLDQAVVVPSATTDAIGKAAKEANMVVSIGVNERDGSTLYNTQLLFDADGTLIQARRKISPTYHERMIWGMGDGSGLRATDSAVGRIGQLACWEHYNPLARYALIEDGEQIHASMYPGSFAGPLFTRQMEVSIRMHALESACFVVNSTAWLYPEQQAQIMADTGCEIGPISGGCYTAIIDPQGEVVGALTEGEGEVIADIDLFQIEIRKRQMDGRGHYSRPEILSLNIDRTPHRHVHERNDQQKPGVIDTAEETGR

SEQ ID NO: 107 - DNA, 981 bp, Unknown
  Obtained from an environmental sample
atggccatcattcgcgcagcagccgtacagatcagcccggttctttacagccgcgaaggcaccgtggacaaggtctgccagcagatcatcacccttggcaaacagggtgtgcagttcgccgtgttcccggaaacggtggtgccgtactacccctatttttcctttgtgcagccggcgttcgccatgggtgcgcaacacctcaaattgctagatcaatctgtaaccgtgccatcggccgccaccctggcgattggcgaagcgtgcaagcaagcaggaatggtcgtttccatcggagtcaatgaacgcgatggcggtacgatttacaacgcgcaattactcttcgatgctgacggcacgctgattcagcatcggcgcaaaatcaccccgacctaccacgagcgcatggtctgggggcagggcgatggttccggtctgcgcgccatcgacagcgcggtcgggcgcatcggctccctggcatgctgggaacattacaacccgctggcccgttacgccttgatggcagacggcgaacagatccacgccgcgatgtttcccggttccctggtgggtgacatcttcgccgagcagatcgaggtcaccatccgccatcacgcattggagtcaggatgcttcgtggtcaatgcaacagcctggctggatgcggatcagcagggccaaataatgcaggacacaggttgcggccttggtcccatctcgggcggctgcttcaccgcgatcgtatcgccggaagggaagctacttggagagccgcttcgctccggggaaggcgtagtgattgccgacctcgatacggccttgatcgacaagcgcaaacggatgatggattcagtaggtcattacagtcgtcccgagctgctcagcctattgatcgatcgatcgccgactgcgcatgttcatgaacgcgccggctttgtttcgagcaacgccggtttgcaggaggtcgcccatgcagaccaatga

SEQ ID NO: 108 - protein, 326 aa, Unknown
  Obtained from an environmental sample
MAIIRAAAVQISPVLYSREGTVDKVCQQIITLGKQGVQFAVFPETVVPYYPYFSFVQPAFAMGAQHLKLLDQSVTVPSAATLAIGEACKQAGMVVSIGVNERDGGTIYNAQLLFDADGTLIQHRRKITPTYHERMVWGQGDGSGLRAIDSAVGRIGSLACWEHYNPLARYALMADGEQIHAAMFPGSLVGDIFAEQIEVTIRHHALESGCFVVNATAWLDADQQGQIMQDTGCGLGPISGGCFTAIVSPEGKLLGEPLRSGEGVVIADLDTALIDKRKRMMDSVGHYSRPELLSLLIDRSPTAHVHERAGFVSSNAGLQEVAHADQ

SEQ ID NO: 109 - DNA, 1092 bp, Unknown
  Obtained from an environmental sample
atggccatcattcgcgcagcagccgtacagatcagcccggttctttacagccgcgaaggcaccgtggacagggtctgccagcagatcatcacccttggcaaacaaggtgtgcagttcgccgtgttcccggaaacggtggtgccgtactacccctatttttcctttgtgcagccggcatttgcgatgggtgcacaacacctcaaattgctcgatcaatctgtaaccgtgccatcggccgccaccctggcgattggcgaagcgtgcaagcaagcaggaatggtcgtttccatcggcgtcaatgaacgcgatggcggtacgatttacaacgcgcaattactcttcgatgctgacggcactctgattcagcatcggcgcaaaatcaccccgacctaccacgagcgcatggtctgggggcagggcgatggttccggtctgcgcgccatcgacagcgcggtcgggcgcatcggctccctggcatgctgggaacattacaacccgctggcccgttacgccttgatggcagacggcgaacagatccacgccgcgatgtttcccggttccctggtgggtgacatcttcgccgagcagatcgaggtcaccatccgccatcacgcattggaatcaggatgcttcgtggtcaatgcaacagcttggctggatgcggatcagcagggccaaataatgcaggacacaggttgcggccttggtcccatctcgggcggctgcttcaccgcgatcgtatcgccggaagggaagctacttggagagccgcttcgctcaggggaaggcgtagtgattgccgacctcgatatggccttgatcgacaagcgcaaacggatgatggattcagtaggtcattacagtcgtcccgagctgctcagcctattgatcgatcgatcgccgactgcgcattttcatgaacgcgccgggctttgttccgagcgacgccggtttgcaggaggtcgcgcatgcagaccaatgaattgctcgctgacctgcaaatccaaggcctgcgttggccggccgcgcaaatggcttgtcgcgccaaggcggcgccggtccttcagaccacaaggcgctgagcctaggtaa

SEQ ID NO: 110 - protein, 363 aa, Unknown
  Obtained from an environmental sample
MAIIRAAAVQISPVLYSREGTVDRVCQQIITLGKQGVQFAVFPETVVPYYPYFSFVQPAFAMGAQHLKLLDQSVTVPSAATLAIGEACKQAGMVVSIGVNERDGGTIYNAQLLFDADGTLIQHRRKITPTYHERMVWGQGDGSGLRAIDSAVGRIGSLACWEHYNPLARYALMADGEQIHAAMFPGSLVGDIFAEQIEVTIRHHALESGCFVVNATAWLDADQQGQIMQDTGCGLGPISGGCFTAIVSPEGKLLGEPLRSGEGVVIADLDMALIDKRKRMMDSVGHYSRPELLSLLIDRSPTAHFHERAGLCSERRRFAGGRACRPMNCSLTCKSKACVGRPRKWLVAPRRRRSFRPQGAEPR

SEQ ID NO: 111 - DNA, 990 bp, Unknown
  Obtained from an environmental sample
atgcccaaaacagtacgtgccgcagcagtccagatcgcgcccgacctgacgtcacgcgccggcaccgtcgagcgggtcctcaatgcaatcgccgaagctgctgacaaaggcgccgagctgatcgtatttcccgagaccttcgtgccctggtatccctatttcagtttcgttctgccacctgtccagcaaggccctgagcatcttcgtctttatgaggaagcagtcacggtaccatcagcagaaacacgggccgtcgcggacgccgcgcgcaaacgcaatgcggttatcgtccttggcgtcaatgagcgcgaccacggctcgctctataacactcagctgatcttcgacgcggatggcagcctgaaactcaagcgtcgcaagatcacgccgacctatcacgaacggatgatctggggccaaggcgatggcgccggcctgaaggttgtcgacactgccgtcggtcgcgtgggtgccctggcatgctgggagcattacaatcctctggcccgctatactttgatggcccagcatgaggaaattcacgcctctcatttcccgggctcactggtcggcccgatattcggcgagcaaatcgaagtcaccatgcgccaccacgcgttggaatcgggctgtttcgtggtcaatgccaccggctggctgagcgaggagcagatcgcatctattcatccggaccccgccttgcaaaagggcctgcgcgatggctgcatgacctgcatcatcacgccggaaggacgccatgtcgtaccgccgctgacctcgggcgaaggcatcctgatcggcgatctggacatgcggctcattaccaagcgcaagcggatgatggattcggtcggacactatgctcggcctgaactgctgcaccttgtccatgacacgacgcccgcacgcgcacgcgagcaggtcggcctttcaggcgattttcccgatgcggagcaagacaagctatttgaggaggttcataatgcgtga

SEQ ID NO: 112 - protein, 329 aa, Unknown
  Obtained from an environmental sample
MPKTVRAAAVQIAPDLTSRAGTVERVLNAIAEAADKGAELIVFPETFVPWYPYFSFVLPPVQQGPEHLRLYEEAVTVPSAETRAVADAARKRNAVIVLGVNERDHGSLYNTQLIFDADGSLKLKRRKITPTYHERMIWGQGDGAGLKVVDTAVGRVGALACWEHYNPLARYTLMAQHEEIHASHFPGSLVGPIFGEQIEVTMRHHALESGCFVVNATGWLSEEQIASIHPDPALQKGLRDGCMTCIITPEGRHVVPPLTSGEGILIGDLDMRLITKRKRMMDSVGHYARPELLHLVHDTTPARAREQVGLSGDFPDAEQDKLFEEVHNA

SEQ ID NO: 113 - DNA, 993 bp, Unknown
  Obtained from an environmental sample
atgacgaaggaacgcgccgcgcgcagcctgcgcgcagctgccatacagcttgaagccgaagtcggcgacatcgccgccaatctcgcacgcatcgaggcgatggtcgaggaggctgcgggcaagggcgccgaactgatcgccattccggagttctgcacctcccgcatgcccttcgatgcacgcgtgcacgacgccgtgctgccgccggacaacttcgtggtcgatgcctttcgccgcatggcagcgacgcacaactgccggctcggcggctccatgctcattgccgacggtggcgagatctacaaccgctaccacttcgtcgaacccgacggcagcgtgcatctgcacgacaaggatctgccgacgatgtgggagaacgccttctacaccggcggctccgacgacggcgtcttcgacaccggcatcggcggcgtcggcgccgcggtgtgctgggaactggtacgcaccggcaccgtgcgacgcatgctcggtcgcgtcgacgtcgccatgaccggcacgcattggtggacgatgccgcacaactggggcagcgccgtcgcgcgcacgctggccgcgatgacgcagtacaaccgctacatgtccgagaatgcacccaccgaattcgcccgccgcctgggtgtgccggtgctgcaggcctcgcactgcggaagcttccgcaccggtttcttgctgctgccaggcagcgggcgtgcactgccctatgacaccgagtacgtcggcgccacacagatcgtcgatgccgatggccacatcctcgcccaccgtcgcacgcaggaaggccccggtgtcgtcgtcgccgacatcacgctcggtgcccgcacgcccgagctgccactggaagaccgcttctggattcccgagctgccgctcttcctcaaggcctactggcaccaccagaacctgtgcggcaagtcctactaccgtcgcgtcggccgcgatgccggcctggcggcggcggagcgttcggcatga

SEQ ID NO: 114 - protein, 330 aa, Unknown
  Obtained from an environmental sample
MTKERAARSLRAAAIQLEAEVGDIAANLARIEAMVEEAAGKGAELIAIPEFCTSRMPFDARVHDAVLPPDNFVVDAFRRMAATHNCRLGGSMLIADGGEIYNRYHFVEPDGSVHLHDKDLPTMWENAFYTGGSDDGVFDTGIGGVGAAVCWELVRTGTVRRMLGRVDVAMTGTHWWTMPHNWGSAVARTLAAMTQYNRYMSENAPTEFARRLGVPVLQASHCGSFRTGFLLLPGSGRALPYDTEYVGATQIVDADGHILAHRRTQEGPGVVVADITLGARTPELPLEDRFWIPELPLFLKAYWHHQNLCGKSYYRRVGRDAGLAAAERSA

SEQ ID NO: 115 - DNA, 993 bp, Unknown
  Obtained from an environmental sample
atgaaccaaatcattaaagcggcggcagttcaatgtagccctgtgttgtatagccaagcgggtacagtcaagaaaatctgtgacacgattttggagttggggcagcaaggtgtgcaatttgccgtatttcctgaaactgttgtgccttattacccttatttttcttttgtgcaaccaccgtttgccatgggtaaagaacatttaaagctattgcatgaatcggttgtcgtgccatcggcagcaacaactttaattggacaggcatgcaaagaagcgaacatggtggtttctattggtattaatgagcgtgcaggcggcacgatttataacgctcaattgttgtttgatgcggatggttcgattattcagcatcgccgtaaaattaccccaacgtatcatgaacgtatggtgtgggggcaaggcgatggcagtggtttacgtgcgatagattctgctgtaggacgtattgggtcgctggcatgttgggagcattacaaccctttggctcggtttgctttgatggcggatggtgagcaaattcatgcggcgatgtttccgggatcactcgtggggcagatttttgcagatcagatcagtgccaccattcagcaccatgctttagagtcgggctgttttgtggtgaatgccacagcatggcttgacccagagcaacaacaacaaattatgcaagatacaggctgtgaactcggtccaatttcggggggatgttttacggccatcgtttctccagaaggcaaatttttgtctgaaccgatcacacaaggcgaaggttatgtgattgccgatttagacttttccttaatcgaaaaacgtaaacggatgatggattctgttgggcattatagtcgtccagaattactcagtttgttgattgatcgtcgtcctacctcagttttgcatgagttaaaactagagaatccatcgaataacagcatcgaaaaagtgtctgaatttgccgaggtacacgcatag

SEQ ID NO: 116 - protein, 330 aa, Unknown
  Obtained from an environmental sample
MNQIIKAAAVQCSPVLYSQAGTVKKICDTILELGQQGVQFAVFPETVVPYYPYFSFVQPPFAMGKEHLKLLHESVVVPSAATTLIGQACKEANMVVSIGINERAGGTIYNAQLLFDADGSIIQHRRKITPTYHERMVWGQGDGSGLRAIDSAVGRIGSLACWEHYNPLARFALMADGEQIHAAMFPGSLVGQIFADQISATIQHHALESGCFVVNATAWLDPEQQQQIMQDTGCELGPISGGCFTAIVSPEGKFLSEPITQGEGYVIADLDFSLIEKRKRMMDSVGHYSRPELLSLLIDRRPTSVLHELKLENPSNNSIEKVSEFAEVHA

SEQ ID NO: 117 - DNA, 957 bp, Unknown
  Obtained from an environmental sample
atgactcaatccaggataattcgtgctgcggcagcgcagatcgctccggatttgcaggttccaggtaacacgatcgacaaagtttgccgcaccatcagcgaggcggccgcaaaaggcgtacagattattgttttccctgaaaccttggtgccttattacccttacttctcttacatttcaccgcccattcaacagggcaaagaacatttgcggctgtatgaccatgcagtggttgtgcccggctcggaaaccgaggcaatttcagctcttgccgcccaacacaatatggtggtggttttgggtgtgaacgagcgcgatcacggcacactttacaacgcacaaattattttcaacagcgacggaaagattctgttgaagcgccgaaaaattacaccaacttatcacgagcggatggtgtgggggcagggtgacgcttcaggcttgaaggtggttgattccgcagtgggccgtgtgggtgcattggcctgttgggaacactacaaccccttggctcgctattgtttgatggcccagcacgaagaaattcactgtgcgcagtttcccggttcattggtggggcaagtttttgccgaccaaatggaagtgaccattcgtcaccacgcacttgagtcgggctgttttgtcatcaacagcaccgcttggctttctgaagaacaggttcaaagtatttcatccgacagcgcattgcagaaagggcttagaggcggttgtttcacggccattgtcagccctgagggaaagctgttggctgagccgctcaccgagggtgagggcatggtgatcgccgacctcgacatggcgttggttacgaaacgcaaacgcatgatggattcagtgggccattatgcgcgccccgagttgttgagtttgctggttcgggatgaggcttcaagccccatgaaaaaaattcagggagttcaacatgctgagtactga

SEQ ID NO: 118 - protein, 318 aa, Unknown
  Obtained from an environmental sample
MTQSRIIRAAAAQIAPDLQVPGNTIDKVCRTISEAAAKGVQIIVFPETLVPYYPYFSYISPPIQQGKEHLRLYDHAVVVPGSETEAISALAAQHNMVVVLGVNERDHGTLYNAQIIFNSDGKILLKRRKITPTYHERMVWGQGDASGLKVVDSAVGRVGALACWEHYNPLARYCLMAQHEEIHCAQFPGSLVGQVFADQMEVTIRHHALESGCFVINSTAWLSEEQVQSISSDSALQKGLRGGCFTAIVSPEGKLLAEPLTEGEGMVIADLDMALVTKRKRMMDSVGHYARPELLSLLVRDEASSPMKKIQGVQHAEY

SEQ ID NO: 119 - DNA, 984 bp, Unknown
  Obtained from an environmental sample
atggatacactcaaagttggattggttcagatggcccccatctggttgaaccgggataaaaccctgatcaaagttgaggaatacatgcagaaagcaggcaaacagggctgcaacctggtagcttttggtgaagcgctggttcccggctaccccttctgggtggaacgcacagagggcgccagattcaattccaaagtccagaaagaactctttgcacattaccttgatcaggcggtgcagatcgaagccggccaccttgatcctctccaggcattagcccaacaatacaagatggctgtgtacgtggggacgattgaacgcccgcctgagcggagcggccacagcctgtactgctccctaatatttatagacccagaaggcgagatcggctcggttcaccgcaagttgatgcccacccatgaggaacgcctggtctggtcaactggcgatgggcacggcctgcgaacacattctctgggcgcctttaccgttggcggactcaactgctgggaaaactggatgccgctctcccgcacagctctttatgccatgggagaggatcttcatgttgctgcctggcccgggagtcagcgcaatacttatgatataaccaaattcattgccaaggaatctcgctcttatgtgatctccgtatccgggatgatgaaaaaagaaaatatcctctctgaaattccccacagccaattgatgctggaaaatagcgaggatattatggctgatggcggatcctgtctggctggaccagatggagaatggatcatcgagcccatcgtcggagaggaaaccctggtaactgctgaactatcacatcagcgggtcagagaagaaagacagaatttcgacccaacaggtcactacagtcggcctgatgtgacccgcctggtagtcgaccgcaggcgccagcagatcctggagatcaccccggacgaaaaaggaagatcggatgaaaatcaatccctttaa

SEQ ID NO: 120 - protein, 327 aa, Unknown
  Obtained from an environmental sample
MDTLKVGLVQMAPIWLNRDKTLIKVEEYMQKAGKQGCNLVAFGEALVPGYPFWVERTEGARFNSKVQKELFAHYLDQAVQIEAGHLDPLQALAQQYKMAVYVGTIERPPERSGHSLYCSLIFIDPEGEIGSVHRKLMPTHEERLVWSTGDGHGLRTHSLGAFTVGGLNCWENWMPLSRTALYAMGEDLHVAAWPGSQRNTYDITKFIAKESRSYVISVSGMMKKENILSEIPHSQLMLENSEDIMADGGSCLAGPDGEWIIEPIVGEETLVTAELSHQRVREERQNFDPTGHYSRPDVTRLVVDRRRQQILEITPDEKGRSDENQSL

SEQ ID NO: 121 - DNA, 1158 bp, Unknown
  Obtained from an environmental sample
atgagcaaaaaagttctaggcggcagagaaaaagtaaaagttgcagtagttcaggctgcgcccgttttcatggacaaggagaagacgattgaaaaggcttgcaagctaataaaagaagcggggagaaatcgagccgagctcatagcgttctcagagtcattcatccccgtctatcctgcatactataccgtcggctatgaaaccccttctcaagaatggagagattacgtgattgcgctacaggataactccgtgctgattccgagcgaggataccgaggtactcggacaggctgcaaaggaggcaggggcttatgcagtaataggatgcagcgagatggacgaccgtccgggaagccgaacagtttacaacacgctcctcttcatcggcaaagacggcaaggtcatgggaaggcatagaaaactcaaacccacgttcacggagagaatatactggggagagggagatgctggagacataaaggtttttgataccgagatcggcaggatcggaggcctcgtatgctgggagaaccatatgactctagtcagggccgcgatgatacacaggggagaggagtttcatatcgcggtctggccgggaaactggaagggtgcggaaaacaagcttctccaagcagataatagcccaggaggcgccctctgcaaccttcaatctctcattaaagtacacgcctttgaggccggggcgtttgtgctgagcgcttgcggctttttgacgccagaggatttcccggaaaggtggcattatataagggatggtaaccatattaactgcgactgggcactgggcggaagctcaatcgtcaatcccgccggccgttatctcgtcgagcctaactttgagaaggatgcaatcctctatgcggattgttatgcaaaccagataaaagcagtaaaagcggtttttgattcccttggccactattcccgctgggatattgcccaactggcgataaggcaggaagcctggaatccagaggtttctttgatcgattcctcttcgactgaagttgagcttccggcagacgagcttcgaaggatttcggagaagtttgaagtaactgcggataagttggaatctttgcttgaggaaattggaaagattaaaaagcccaggaaacaagccggttcctaa

SEQ ID NO: 122 - protein, 385 aa, Unknown
  Obtained from an environmental sample
MSKKVLGGREKVKVAVVQAAPVFMDKEKTIEKACKLIKEAGRNRAELIAFSESFIPVYPAYYTVGYETPSQEWRDYVIALQDNSVLIPSEDTEVLGQAAKEAGAYAVIGCSEMDDRPGSRTVYNTLLFIGKDGKVMGRHRKLKPTFTERIYWGEGDAGDIKVFDTEIGRIGGLVCWENHMTLVRAAMIHRGEEFHIAVWPGNWKGAENKLLQADNSPGGALCNLQSLIKVHAFEAGAFVLSACGFLTPEDFPERWHYIRDGNHINCDWALGGSSIVNPAGRYLVEPNFEKDAILYADCYANQIKAVKAVFDSLGHYSRWDIAQLAIRQEAWNPEVSLIDSSSTEVELPADELRRISEKFEVTADKLESLLEEIGKIKKPRKQAGS

SEQ ID NO: 123 - DNA, 990 bp, Unknown
  Obtained from an environmental sample
atgtcaactttcaagatcgctaccgtgcagagtgcaccagtatttatggaccgcgaagctaccattgacaagacttgcgagctgatcgccgaagcagcacaagatgacgacgttcgcctagtggtcttccccgaggcctttatccccacctatccggactgggtatggcgtatccctcccggacagcaccagatgcttgccgacctgtacggggagttgctcgagcagtcggtgacgatacccagtctggctaccgagcggctctgtcaggctgcaaagaaagcgggcgtttatgtagctgtgggccttaacgaacgcaatacagaggccagcaacgctaccctgtacaacaccctgctctacattgacgccgagggcaacttgctaggtaagcaccgaaagctggtaccgaccgctcccgaacgcatggtctgggcacagggagatggcagtacccttgaggtctacgagacctccttcggaaaactcagcggactaatctgttgggagaactacatgcctctcgctcgttatgccctgtatgcctggggagtacagctctatttggctcctacttgggatcgaggcgagccctggctttccactctgcggcacattgccaaggaaggacgagtatacgtggtcggctgctctatcgccttacgtaaggaagacatccccgaccgattcgaattcaaggcgaagtactacgcagaggcaggagagtggataaacaaaggtgacagcgtcatcgtcggtcccgatggcgagctcatcgccgggcctctacataaggaacaggggatactctatgctgagctggacacaaggcagatgcacgcccccaagtggaacctggatgtagccggacactacgcgcgcccggacgtgtttcggctgaccgtgagcaaggatggccatccgatgctcggcgttgcccaagggcccaagcatgagccgcaagataagaccgaagtattagagggctag

SEQ ID NO: 124 - protein, 329 aa, Unknown
  Obtained from an environmental sample
MSTFKIATVQSAPVFMDREATIDKTCELIAEAAQDDDVRLVVFPEAFIPTYPDWVWRIPPGQHQMLADLYGELLEQSVTIPSLATERLCQAAKKAGVYVAVGLNERNTEASNATLYNTLLYIDAEGNLLGKHRKLVPTAPERMVWAQGDGSTLEVYETSFGKLSGLICWENYMPLARYALYAWGVQLYLAPTWDRGEPWLSTLRHIAKEGRVYVVGCSIALRKEDIPDRFEFKAKYYAEAGEWINKGDSVIVGPDGELIAGPLHKEQGILYAELDTRQMHAPKWNLDVAGHYARPDVFRLTVSKDGHPMLGVAQGPKHEPQDKTEVLEG

SEQ ID NO: 125 - DNA, 1050 bp, Unknown
  Obtained from an environmental sample
atgacaactgtaaaaaagacggtacgcgcagcagcgatccagatcgcacctgacctcgacagtgcaggcggtacgctggacaaggtttgcacggccattcaaaaggcggcggcacaaggcgcggagctggtggtttttcccgaaaccttcttgccctactatccttacttttcattcgtgcggccgcccttcgcatccggcccggaacacttgctgctatatgaacgcgcagtggcggtgccaggcccggtgaccgatgccgtctctgccgtcgcgcgcagccacggcgtggtggtggtactcggcgtcaatgaacgcgaccatggcacgctgtacaacacccaactggtgttcgacgcgaatggcgaactggtgttgaaacgcagaaaaatcacgccgacttatcacgagcggatgatctggggtcaaggcgacggcagcggactcaaagtagtgcaaacggcggtcggccggctaggcgcgctagcctgttgggaacactacaacccactggcccgttatgcattgatggcgcaacacgaagaaatccattgcgcccagtttcccgggtccatggtcgggcaaatattcgccgaccagatggaagtgacgatacgccatcacgctctcgagtcggcttgcttcgtggtgaatgccacaggctggctgaccgatgcgcaaatcacatcgatcacgccggaccccgcgctacaaaaggcattacgtggcggttgctgcaccgccatcgtctcgccggaaggtgtgctcctggcagagccgctacgcagcggcgaaggcatggtgatcgccgatctcgatatggcactcatcaccaaacgcaaacggatgatggattcggtcggccactatgcgcggcccgaattgttaagcctgcttgtcgacgaccggcgcaaggtaccggtatccgcgctatttgccgacagcaaccctgccaacgggcacacagttttcaccccatccgacataccaacccttgggagcgcacatcatgcaaacagttaccaaaccgaaccagcaactgatcactga

SEQ ID NO: 126 - protein, 349 aa, Unknown
  Obtained from an environmental sample
MTTVKKTVRAAAIQIAPDLDSAGGTLDKVCTAIQKAAAQGAELVVFPETFLPYYPYFSFVRPPFASGPEHLLLYERAVAVPGPVTDAVSAVARSHGVVVVLGVNERDHGTLYNTQLVFDANGELVLKRRKITPTYHERMIWGQGDGSGLKVVQTAVGRLGALACWEHYNPLARYALMAQHEEIHCAQFPGSMVGQIFADQMEVTIRHHALESACFVVNATGWLTDAQITSITPDPALQKALRGGCCTAIVSPEGVLLAEPLRSGEGMVIADLDMALITKRKRMMDSVGHYARPELLSLLVDDRRKVPVSALFADSNPANGHTVFTPSDIPTLGSAHHANSYQTEPATDH

SEQ ID NO: 127 - DNA, 1005 bp, Unknown
  Obtained from an environmental sample
atgatagcacggaagacaataagggcggcggcggtgcagatagcgcctgtgatggaagatcggaaggcgacgaccgacaaggtgtgcgcctacattcaggaagcaggcgagaatggagccgaaattgtggtgtttcctgaaaccttcattcccaattatccctatttctcttttgtaaaacctcccgtgttggcaggtaaggatcaccttaccttgtatgaccaagcggtggaaatccctagccctactaccgaccaagtggggtctatggccaaaaaatggggaatcgtagtggtgttgggcgtgaacgaaagaagccacggcactttgtacaatgcccaaattgtctttgacgctactggtgatattgtattggtgagacgcaaaatcacccctacctatcatgaacggatgatctggggacagggagatggcagtggattaaaagcagtagacacagctgtgggaagagtgggcgctttggcgtgttgggaacactataatccacttgcgcgctacgcccttatggtagaccatgaggaaattcattgcagccaattccctggctctatggtcggccccattttcggtgaccagatagaagtgacgattcgccaccatgcgttggaatcgggttgttttgtcatcaattccacaggttggctgtttgaagagcaaatccaagccatcaccgatgatccgaaactgcacaaagcattgaaagacggctgtatgaccgccattatttctcccgaaggcgtgcatttgaccaaacccttaacagaaggcgaaggcatcatctacgcctatctggacatgaaactcatagacaagcggaaacggatgatggactcggtaggacactatgcacgtccagagttgctctctttgcatatcaacaatgcagagcaaaaaccagccgtttacacctctcctcttaccaaaacggaaaccaaagaagacgtaaaaagctatgatcgcaacaaagaacagcttatcgtctga

SEQ ID NO: 128 - protein, 334 aa, Unknown
  Obtained from an environmental sample
MIARKTIRAAAVQIAPVMEDRKATTDKVCAYIQEAGENGAEIVVFPETFIPNYPYFSFVKPPVLAGKDHLTLYDQAVEIPSPTTDQVGSMAKKWGIVVVLGVNERSHGTLYNAQIVFDATGDIVLVRRKITPTYHERMIWGQGDGSGLKAVDTAVGRVGALACWEHYNPLARYALMVDHEEIHCSQFPGSMVGPIFGDQIEVTIRHHALESGCFVINSTGWLFEEQIQAITDDPKLHKALKDGCMTAIISPEGVHLTKPLTEGEGIIYAYLDMKLIDKRKRMMDSVGHYARPELLSLHINNAEQKPAVYTSPLTKTETKEDVKSYDRNKEQLIV

SEQ ID NO: 129 - DNA, 1011 bp, Unknown
  Obtained from an environmental sample
atgtcagaaaagcgaattattaaagcggctgcagttcaaatcacaccagattttgaatcgcatgatggaaccgtaaagaaggtttgtaatgtaattgatgaagcgggtgctaaaggtgtacagatcattgtattccctgaaacctttattccatattacccatatttttctttcatcactccaccagtgactgctggcgcggagcatttgcggctctatgaaaaaagtgtcgtgatacctggtcccgttactcaagccatttccgaacgtgcacgcatgaataatatggttgttgtacttggtgtaaatgagcgtgataacggcagtctatataacacccagattatttttgatgctaccggtgagatgcttctgaagagaagaaaaatcacacctacctatcatgagcgcatgatttgggggcaaggagatgcttcaggcctgaaggtcgtcgatacggctattgggcgagtcggagcattggcatgctgggagcactataaccctttggctagatacagcctcatgacacagcatgaagaaattcactgtgctcaatttccaggctccatggttggtcagatcttcgcagatcaaatggatgtcacgattcgtcatcatgccttggagtcaggttgcttcgtcatcaactccactggctggttaactgatgatcagatcaaatctatcaccgacgatcccaaaatgcagaaagctttaagaggtggttgcaacacggccattatttctccagaagggaatcatttaaccgagcctttgcgagaaggtgaaggcatggtgattgctgatcttgatatggcactcatcaccaaacgaaaaagaatgatggactcagttggccactacgccagaccagaactgttgagcttagcgatcaatgatgctccggctactccttcattccagatgaacgaacatcgtcttaaatcagtgcaattacctatcgcagaggagcttaaaaatgacaacaagcttagcagtggacagtaa

SEQ ID NO: 130 - protein, 336 aa, Unknown
  Obtained from an environmental sample
MSEKRIIKAAAVQITPDFESHDGTVKKVCNVIDEAGAKGVQIIVFPETFIPYYPYFSFITPPVTAGAEHLRLYEKSVVIPGPVTQAISERARMNNMVVVLGVNERDNGSLYNTQIIFDATGEMLLKRRKITPTYHERMIWGQGDASGLKVVDTAIGRVGALACWEHYNPLARYSLMTQHEEIHCAQFPGSMVGQIFADQMDVTIRHHALESGCFVINSTGWLTDDQIKSITDDPKMQKALRGGCNTAIISPEGNHLTEPLREGEGMVIADLDMALITKRKRMMDSVGHYARPELLSLAINDAPATPSFQMNEHRLKSVQLPIAEELKNDNKLSSGQ

SEQ ID NO: 131 - DNA, 1011 bp, Unknown
  Obtained from an environmental sample
atgtcagaaaagcgaattattaaagcggctgcagttcaaatcacaccagattttgaatcgcatgatggaaccgtaaagaaggtttgtaatgtaattgatgaagcgggtgctaaaggtgtacagatcattgtattccctgaaacctttattccatattacccatatttttctttcatcactccaccagtgactgctggcgcggagcatttgcggctctatgaaaaaagtgtcgtgatacctggtcccgttactcaagacatttccgaacgtgcacgcatgaataatatggttgttgtacttggtgtaaatgagcgtgataacggcagtctatataacacccagattatttttgatgctaccggtgagatgcttctgaagagaagaaaaatcacacctacctatcatgagcgcatgatttgggggcaaggagatgcttcaggcctgaaggtcgtcgatacggctattgggcgagtcggagcattggcatgctgggagcactataaccctttggctagatacagcctcatgacacagcatgaagaaattcactgtgctcaatttccaggctccatggttggtcagatcttcgcagatcaaatggatgtcacgattcgtcatcatgccttggagtcaggttgcttcgtcatcaactccactggctggttaactgatgatcagatcaaatctatcaccgacgatcccaaaatgcagaaagctttaagaggtggttgcaacacggccattatttctccagaagggaatcatttaaccgagcctttgcgagaaggtgaaggcatggtgattgctgatcttgatatggcactcatcaccaaacgaaaaagaatgatggactcagttggccactacgccagaccagaactgttgagcttagcgatcaatgatgctccggctactccttcattccagatgaacgaacatcgtcttaaatcagtgcaattacctatcgcagaggagcttaaaaatgacaacaagcttagcagtggacagtaa

SEQ ID NO: 132 - protein, 336 aa, Unknown
  Obtained from an environmental sample
MSEKRIIKAAAVQITPDFESHDGTVKKVCNVIDEAGAKGVQIIVFPETFIPYYPYFSFITPPVTAGAEHLRLYEKSVVIPGPVTQDISERARMNNMVVVLGVNERDNGSLYNTQIIFDATGEMLLKRRKITPTYHERMIWGQGDASGLKVVDTAIGRVGALACWEHYNPLARYSLMTQHEEIHCAQFPGSMVGQIFADQMDVTIRHHALESGCFVINSTGWLTDDQIKSITDDPKMQKALRGGCNTAIISPEGNHLTEPLREGEGMVIADLDMALITKRKRMMDSVGHYARPELLSLAINDAPATPSFQMNEHRLKSVQLPIAEELKNDNKLSSGQ

SEQ ID NO: 133 - DNA, 1026 bp, Unknown
  Obtained from an environmental sample
atgtcgaccaagcggatcgtacgcgccgctgccgttcagctggcaccggatctggagcggccggagggcacactggagaaggtttgcgcggccatcgacaaggcggcgggggacggtgtgcagctcatcgtcttccccgagaccttcgtaccgtactacccgtacttctctttcgtgcgtgcgccggtcgcgatgggtgccgagcacatgcggttatacgagcgcgcggtagcggtgcccggtccagtaacggccaccgtggcggagcgggcaaaagcgcacgcgatggtcgtcgtgctgggtgtaaacgagcgcgatcacggctcactgtataacgcgcaactgatcttcgacgagaccggccgtctcgtcctcaaacgccgcaagatcactccgacctatcacgagcgcatggtgtgggggcagggcgacggcagcggccttaaggttgtagacaccggtatcggcaggatcggagccctcgcctgctgggagcactacaacccgctcgcgcgctatgcgctcatggcgcagcacgaagagattcattgcgcgcagtttccgggctcgatggtggggccgatcttcgcggatcagatcgaggtcacgatccgccatcacgcgctggagtcgggctgcttcgtcgtcaatgcgaccggctggctgacacccgaacagatcgcgtcgatcacaccggacgcgggtctgcaaaaggcaatcagcgggggctgcaacaccgcgatcatctcgccggagggcgtgcacctggccccgccgttgcgagaaggtgagggcatggtcgtggccgacctcgacatggcgctcatcaccaaacgcaaacgcatgatggattcggtgggtcactacgctcgcccggagttgctcagcctgcgcatcgatagccgcgccgcttcgccgatgtcgtcacaaatggaaatacccgggagcttgcatgaaatcaccagccacgatgtccagccagcaactgatgaccgagctccagtcctccggcttgaggttggctga

SEQ ID NO: 134 - protein, 341 aa, Unknown
  Obtained from an environmental sample
MSTKRIVRAAAVQLAPDLERPEGTLEKVCAAIDKAAGDGVQLIVFPETFVPYYPYFSFVRAPVAMGAEHMRLYERAVAVPGPVTATVAERAKAHAMVVVLGVNERDHGSLYNAQLIFDETGRLVLKRRKITPTYHERMVWGQGDGSGLKVVDTGIGRIGALACWEHYNPLARYALMAQHEEIHCAQFPGSMVGPIFADQIEVTIRHHALESGCFVVNATGWLTPEQIASITPDAGLQKAISGGCNTAIISPEGVHLAPPLREGEGMVVADLDMALITKRKRMMDSVGHYARPELLSLRIDSRAASPMSSQMEIPGSLHEITSHDVQPATDDRAPVLRLEVG

SEQ ID NO: 135 - DNA, 1011 bp, Unknown
  Obtained from an environmental sample
atgtcagacaagcgaatcattaaagcggctgcagttcaaatcactcctgactttgactcagcagatggaaccgttaagaaagtgtgcaaggtaatcgatgaagcaggtgcaaagggagttcaaattattgtattcccggaaaccttcatcccttactacccatacttttcattcattacacctccagtcactgctggcgctgagcatttaaagctttatgagaaaagtgtcgtgatacctggcccggttacccaagcgattgccgagcgagccagggttaatcagatggttgtcgtgcttggtgtcaacgagcgagataacggtagcctctacaacacacaattgatctttgataccaacggcgaactgctacttaaaagaagaaaaatcacccctacctaccatgaacgtatgatctgggggcaaggtgatgcatcaggtctcaaagtagttgaaacagagatcgcccgagtaggtgccttggcttgttgggaacactacaacccactggccagatatgcactcatgacacagcatgaagaaattcactgtgcgcaattcccaggctctatggttggccagatatttgccgatcagatggatgtcactatccgacatcacgccttagagtcaggctgcttcgtcatcaacgccactggctggctcaccgacgcgcaaatccaatcgattactgatgacccaaaaatgcaaaaagcattacgtggcggctgcaacacagccatcatctcccccgaaggggtgcacttaacagagccactacgtgaaggagaaggcatggtgattgccaatcttgatatggcactcatcacaaaacgaaaaagaatgatggattcggtaggccattattcaagaccagaattattaagcctggcaattaacgacaaaccagcaactacaacattttcaatgactgaggggcgtactcaaacagagccatttcgaatcgcagaggagttgaaaaatgacgacaagcttagcactggaaactaa

SEQ ID NO: 136 - protein, 336 aa, Unknown
  Obtained from an environmental sample
MSDKRIIKAAAVQITPDFDSADGTVKKVCKVIDEAGAKGVQIIVFPETFIPYYPYFSFITPPVTAGAEHLKLYEKSVVIPGPVTQAIAERARVNQMVVVLGVNERDNGSLYNTQLIFDTNGELLLKRRKITPTYHERMIWGQGDASGLKVVETEIARVGALACWEHYNPLARYALMTQHEEIHCAQFPGSMVGQIFADQMDVTIRHHALESGCFVINATGWLTDAQIQSITDDPKMQKALRGGCNTAIISPEGVHLTEPLREGEGMVIANLDMALITKRKRMMDSVGHYSRPELLSLAINDKPATTTFSMTEGRTQTEPFRIAEELKNDDKLSTGN

SEQ ID NO: 137 - DNA, 978 bp, Unknown
  Obtained from an environmental sample
atggctattgtcaaggccgcggcggtgcagatcagtccggtgctctacagtcgcgccggcacagtggacaaggtcgtcgcgaagatccgcgagctgggccgacgaggggtcgagttcgccgtcttccccgagaccgtcattccctactatccctacttctctttcgtgcagcccccctacacccaggccaccgaacacctgcgcctgctcgaggaatcggtgaccgtgccctccgccgaaaccgacgcgatcgccaaggccgctcgcgaggcgggcatggtcgtctccatcggcgtcaacgagcgcgacggcggaaccatctacaacacccaactcctcttcgacgccgacggcactctcatccagcgccgccgcaagatcacccccacctatcacgaacgcatggtctgggggcagggagacggctcaggtctgcgcgccgtcgacagtgcggtcggccgcatcggccagctcgcctgctgggagcactaccagccactggcccggtacgccctcatcgctgacggcgagcagatccacgccgcgatgtaccccggcgccttcggcggcgatctgttcgccgagcagatcgaggtcaacatccgccagcacgccctggaatccgccagcttcgtcgtcaacgccaccgcctggctcgacgccgatcagcaggcccagatcgccaaggacaccggaggcccggtcccggccttctccggtggcttcttcaccgccatcgtcgaccccgaaggccgtatcatcggcgaccccctcaccagcggcgaaggcgaagtgatcgccgacctcgatctcgctctcatcaaccgccgcaagcgcctcatggacgccagtggacactaccagccgcccgaaattcttagcttcacattgaccggtgcaccggcgccttatgtcaagagcgcggcgtgccggggaaccccgggtacgaccgtggccgaggagggacggtccgcttag

SEQ ID NO: 138 - protein, 325 aa, Unknown
  Obtained from an environmental sample
MAIVKAAAVQISPVLYSRAGTVDKVVAKIRELGRRGVEFAVFPETVIPYYPYFSFVQPPYTQATEHLRLLEESVTVPSAETDAIAKAAREAGMVVSIGVNERDGGTIYNTQLLFDADGTLIQRRRKITPTYHERMVWGQGDGSGLRAVDSAVGRIGQLACWEHYQPLARYALIADGEQIHAAMYPGAFGGDLFAEQIEVNIRQHALESASFVVNATAWLDADQQAQIAKDTGGPVPAFSGGFFTAIVDPEGRIIGDPLTSGEGEVIADLDLALINRRKRLMDASGHYQPPEILSFTLTGAPAPYVKSAACRGTPGTTVAEEGRSA

SEQ ID NO: 139 - DNA, 999 bp, Unknown
  Obtained from an environmental sample
atgaaaacaacggttaccgttgcctgcgttcaggccgcccccgtatttatggatttagaaggcaccgtagataaaacaatcaccctcatctctgaagccgcacagaaaggcgcggagctcatcgcttttccggagacctggatacccggttacccgtggttcttatggctgaactcgcccgccacaaatatgcccctggtttatcagtatcatcagaactctctggtgctggacagtacccaggcgaagcgaattgcggatgcggcacggcagaataacatcactgtcgctctgggcttcagcgaacgcgatcatggaagcctctatatcgcacagtggctgattggcagcgacggggagaccattggcatccggcgcaagctcaaggccacgcacgtggagcgtacgctgttcggcgaaagcgacggctcctccctgaccacctgggagacacctctgggtaacgtcggggccctctgctgctgggagcacctgcagccgctgtcccgctatgcaatgtattcccagcatgaggagatccacatcgctgcctggcccagtttcagtctctacaccagtgcaacggccgcactgggtcctgacgtcaatacggcggcttcacgcctctatgccgcggaggggcagtgcttcgtgatagccccgtgtgccgtggtttctgatgaaatgattgatttactctgtcctgatgatgaccggagagcgttactcagtgccggagggggacatgcccgtatttacggcccggacggaagagaactcgtcacccctctcggggaaaatgaggaaggactgcttatcgctgagctcgactctgctgcgattacctttgccaaactggcggcagacccggttggccactattcccgtcctgacgtgacccgcctcctttttaatccttcagccaacaagactgtgattaaacgacattcgcctcctgagttaattgccgagcagactgcagaagaagaggaggagtag

SEQ ID NO: 140 - protein, 332 aa, Unknown
  Obtained from an environmental sample
MKTTVTVACVQAAPVFMDLEGTVDKTITLISEAAQKGAELIAFPETWIPGYPWFLWLNSPATNMPLVYQYHQNSLVLDSTQAKRIADAARQNNITVALGFSERDHGSLYIAQWLIGSDGETIGIRRKLKATHVERTLFGESDGSSLTTWETPLGNVGALCCWEHLQPLSRYAMYSQHEEIHIAAWPSFSLYTSATAALGPDVNTAASRLYAAEGQCFVIAPCAVVSDEMIDLLCPDDDRRALLSAGGGHARIYGPDGRELVTPLGENEEGLLIAELDSAAITFAKLAADPVGHYSRPDVTRLLFNPSANKTVIKRHSPPELIAEQTAEEEEE

SEQ ID NO: 141 - DNA, 1026 bp, Unknown
  Obtained from an environmental sample
atggtgttcaaggcagcgactgttcatgcagctccggtattcatggacaaggaagcgtcgatagataaggctatcgacctcatcaagaaggccggtcaggaagggattaagcttctggtttttccggaaacgtttattccgggctatccgtattttatcgaatgctatccgccgcttgcgcaggtggaagcgctcgcccagtacactgacgcttccgtggagatcgacggcccggaagtcacccggcttcagcaggtagccaaggcggcaggcgttgcagtcgtcatgggcatcagcgaacgaatggctgagacccgaacctgcttcaactcgcaggtgttcattgacgtcgacggcacgctgctcggcgtgcatcgcaagctgcagccgacttatgccgagcgcaaggtatgggcacagggcggtggttatacgctgaggacctacaagagctcgcttggcgtgctcggcggtcttgcctgctgggagcacacgatgaacctcgcgcggcaggccctgatcatgcagagcgagcagatccatgcggctgcatggcccggactatcgacgatgcgaggtttcgagcccgtggccgatatccagatcgacgccatgatgaagactcacgcgcttaccgcacagtgctgggtgctttcggccggcaatcccgtcgaccggacctgcctcgactggatggaaaagaacatcggaccgcaggattacgtcaccgagggcggcggatggagcgccgttatccatccgttcaacagctatctcggcggccctcacacgggccttgaggaaaagctggtcgtcggcgagatcaatctggacgatctcaagttcgtcaaagtctggctcgacagcaaagggcactatgctcggccggaaatcctgaaacttggcgtcaaccaaaagcagatttggcctgatgaacatttgctggcgcggcaggatgtgaccgagttgctggaggcggatatcatcgaataccccttgcaactgttgcaagaccgcgcgcaatag

SEQ ID NO: 142 - protein, 341 aa, Unknown
  Obtained from an environmental sample
MVFKAATVHAAPVFMDKEASIDKAIDLIKKAGQEGIKLLVFPETFIPGYPYFIECYPPLAQVEALAQYTDASVEIDGPEVTRLQQVAKAAGVAVVMGISERMAETRTCFNSQVFIDVDGTLLGVHRKLQPTYAERKVWAQGGGYTLRTYKSSLGVLGGLACWEHTMNLARQALIMQSEQIHAAAWPGLSTMRGFEPVADIQIDAMMKTHALTAQCWVLSAGNPVDRTCLDWMEKNIGPQDYVTEGGGWSAVIHPFNSYLGGPHTGLEEKLVVGEINLDDLKFVKVWLDSKGHYARPEILKLGVNQKQIWPDEHLLARQDVTELLEADIIEYPLQLLQDRAQ

SEQ ID NO: 143 - DNA, 1122 bp, Unknown
  Obtained from an environmental sample
atgacgatcattgcaggcgcggttcatgcggcgccggtattcatggatgtcgatgccactatcgacaaggcatgcgaaatcattcgcaaggcaggcaaagacggaatcgagcttctcgtcttccctgaggttttcgtacccggctacccctacttcatcgagtgctatccgaccttgaaccaaaccgctgcgctggccgcctatacggatgcctcgatcgaggttccaggcccggaagtccggcgcttgcaggtggccgcacatcaggccggcgtgatggttgtgatgggcgtgagcgagcgtctgcgcggatctcgcacctgcttcaacagccaggtgttcatcgaccgtgacggcaccttgctgggcgtgcaccgcaaactccagccgacctatgtcgagcgcatcgtctggggccagggcggcggacacaccctcaaggtattcgacagcacactgggcaaggtgggcggactggcctgctgggagcacacgatgaacctcgcgcgccatgcgttgatcgcccagggtatccagatccatgccgccgcctggcctgggctttcgacaatggccgggttcgaagcggtggctgacgtccagatcgacgcgatgatgaaaactcatgcgttgagcgcgcaatgctttgtcgtatcggccgcaaaccctgtggatcagacctgcctggagtggatggagaaacacctcggcccgcagcaactcgttaccgccggcggaggctggtcggcaatcgtccatcctttctgtggttatatcgccgcccctcacaccggtgccgaggagaaggttctggtaggcgaaatcaatctggacgacctcaagcaggtcaaggtatgggttgattccgcaggtcattatgcgcgcccggaagtcgtgcaattgcgcgacgccctggagagccgtggcaattatcgcgttgcgctgacccgcgacgccgacaccttcgtgccgctggaagaccgcgtgcgctttgcgcgccagcagaacgccgacctcttcatctcgatccacgccgacgccaacgccaaccacgatgcgcgcggggctggcttcacttcgaaggttgaaaacctttccacgggcattttaccaggcgattga

SEQ ID NO: 144 - protein, 373 aa, Unknown
  Obtained from an environmental sample
MTIIAGAVHAAPVFMDVDATIDKACEIIRKAGKDGIELLVFPEVFVPGYPYFIECYPTLNQTAALAAYTDASIEVPGPEVRRLQVAAHQAGVMVVMGVSERLRGSRTCFNSQVFIDRDGTLLGVHRKLQPTYVERIVWGQGGGHTLKVFDSTLGKVGGLACWEHTMNLARHALIAQGIQIHAAAWPGLSTMAGFEAVADVQIDAMMKTHALSAQCFVVSAANPVDQTCLEWMEKHLGPQQLVTAGGGWSAIVHPFCGYIAAPHTGAEEKVLVGEINLDDLKQVKVWVDSAGHYARPEVVQLRDALESRGNYRVALTRDADTFVPLEDRVRFARQQNADLFISIHADANANHDARGAGFTSKVENLSTGILPGD

SEQ ID NO: 145 - DNA, 1014 bp, Unknown
  Obtained from an environmental sample
atgggcatcacccacccgaactacaaggtcgcagtggtccaggctgcgccggtctggttgaacctcgaggcaacggtcgagaagacaatcaggtatattgaagaggcggccaaggctggagcgaagctgatagcgtttccggaaacctggattccgggctatccatggcacatttggatcggaacgcccgcatgggcaatcggtaagggcttcgtccagcgctatttcgacaactcgctcagctatgacagcccgctcgcgcggcagatcgctgacgccgcagcaaagagcaagatcacggttgttctcggcctctccgagcgcgacggtggaagcctatacatcgcgcaatggctgatcggaccagatggcgagaccatcgcgaagcggcgcaagctgcgtccgacccacgtcgagcgcacggtgttcggtgacggtgacggcagccacatcgccgtgcatgaccgatccgatctgggccggctcggggcgttgtgctgctgggagcacgtgcagccgttgacgaaattcgcgatgtacgcgcagaacgagcaggttcacgtggcagcatggccgagcttctcgatgtacgaaccctttgcgcatgcgctgggttgggagacgaacaacgcggtcagcaaggtctacgcggtcgagggatcgtgcttcgtgctcgctccctgtgccgttatttcgcaagcgatggtggacgagatgtgcgacactcccgacaagcgcgagcttgttcacgccggcggcggccacgcggtgatttacggccctgacggaagcccgctcgcagaaaagctcggggaaaacgaagaggggcttctctacgcgacggtcaatcttgctgcgatcggggttgccaagaatgccgcggatccggccgggcactattcgcgtccggacgttctaaggctgctattcaacaagagcccggcccgaagagtggagcattttgcgctgccgcacgagcagctcgagatcggggcaggcccgtctggcgactga

SEQ ID NO: 146 - protein, 337 aa, Unknown
  Obtained from an environmental sample
MGITHPNYKVAVVQAAPVWLNLEATVEKTIRYIEEAAKAGAKLIAFPETWIPGYPWHIWIGTPAWAIGKGFVQRYFDNSLSYDSPLARQIADAAAKSKITVVLGLSERDGGSLYIAQWLIGPDGETIAKRRKLRPTHVERTVFGDGDGSHIAVHDRSDLGRLGALCCWEHVQPLTKFAMYAQNEQVHVAAWPSFSMYEPFAHALGWETNNAVSKVYAVEGSCFVLAPCAVISQAMVDEMCDTPDKRELVHAGGGHAVIYGPDGSPLAEKLGENEEGLLYATVNLAAIGVAKNAADPAGHYSRPDVLRLLFNKSPARRVEHFALPHEQLEIGAGPSGD

SEQ ID NO: 147 - DNA, 1098 bp, Unknown
  Obtained from an environmental sample
atgacccagcacgagaccactgcccggaggctggcagctgtgcatgccgcgcctgtgttcatggacaccgacgcgaccatcgacaaggtgatcggcttcgtcgaacaggccggccgcgaaggcatcgaactcctggtgttccccgagaccttcgtgcctggttacccctactggatcgagtgctatccgccgctgcagcaggtggccgccaacgcgcagtacacggacgcctccgtcgaggtgcctggtccggagatcaagcgggtgcaggcggcctgtgcccgcgctggcgtcgaagtcgtcctcggcgtcagcgagcgactcaggggtaccaggacatgcttcaactcccaggtgttcatcgacgccgacgggagcctgctcggcgtgcaccgcaagctgcagccgacgtacgtggagcgcatcgtgtgggcccagggcggaggcgcgaccctgtcggtgttcggctcccgctccggccggatcggcggtctggcctgctgggagcacacgatgaacctggctcgtcaggcactgcttgagcaggagcagcagatccacgcggcggcgtggcctgccctgtcgacgatggcggggttcgagaccgtcgcggacgcccagatcgaggccatgatgaagacccatgcgctcacggcacaggtgttcgtcatctgcgcgtccaacccggtcgacggcacttgcctggaatggatgcgggacaacctcggtgaacagaagttcgtgaccgccggagggggctggtccgcggtcatccaccccttcaactccttcctcggcgggccgcataccggtttggaggagaagctcgtcagcgcgacgatcgacttctccgacatccgcttggtcaaggcctgggttgattcgaaggggcactacgcgcggcccgaggtcctgcgactcgcggtcgaccgcaagccactgtggcacgacgagtgcgaggtgccgggacaggcgcaggtacgcacccgcgctgcttctctggcagtgcaggagcacccggtggtgctgcctcagggggcggcgcggcccgctccgcaagactgggacacctctgcggcgcaggagctgacttcctga

SEQ ID NO: 148 - protein, 365 aa, Unknown
  Obtained from an environmental sample
MTQHETTARRLAAVHAAPVFMDTDATIDKVIGFVEQAGREGIELLVFPETFVPGYPYWIECYPPLQQVAANAQYTDASVEVPGPEIKRVQAACARAGVEVVLGVSERLRGTRTCFNSQVFIDADGSLLGVHRKLQPTYVERIVWAQGGGATLSVFGSRSGRIGGLACWEHTMNLARQALLEQEQQIHAAAWPALSTMAGFETVADAQIEAMMKTHALTAQVFVICASNPVDGTCLEWMRDNLGEQKFVTAGGGWSAVIHPFNSFLGGPHTGLEEKLVSATIDFSDIRLVKAWVDSKGHYARPEVLRLAVDRKPLWHDECEVPGQAQVRTRAASLAVQEHPVVLPQGAARPAPQDWDTSAAQELTS

SEQ ID NO: 149 - DNA, 942 bp, Unknown
  Obtained from an environmental sample
atgacgaagcttgagaaggtggtcgcggcggcggtccaggcgacgccggagttcctcgaccgcgaggcgaccgtcgagaaggccgtgcggctgatcaaggaagcggccggggagggcgccggcctgatcgtgttccccgagacgttcatcccgacgtacccggactgggtctggcgcgcgccggcctgggacggcccatccgcggacctgtacgcaatgctgctggagaacgcggtggagatccccgggccggtgacggagaccctggggaaggcggcgaagcaggccaaggccttcgtgtcgatgggcgtcaacgagcgcgagccgggcggcgggacgatctacaacacgcaggtcacgttcggacccgacgggagcgtgctcggcaagcaccgcaagctgatgccgaccggcggcgagcgcctggtgtgggggatgggcgacgggtcgatgctccaggtctatgacacgccgttcggccgcctgggcgggctgatctgctgggagaactacatgccgctcgcgcgctactcgatgtacgccaagggcgtggacgtctacgttgcgccgacgtgggacaacagcgacatgtgggtggcgacgctccgccacatcgccaaggaggggcggctgtacgtgatcggcgtggcgccgctgctgcgcgggtcggacgtccccgacgacgtgccggggaaggccgagctgtggggcggcgatgacgactggatgtcgcgcggcttctccaccatcgtcgcgccgggcggcgaggtgctggccggtccgctgacggaggaggaaggcatcctctacgcggagatcgacccggcgagagcccgttcgtcacggcaccagttcgatccggtggggcactactcgcgccccgacgtgtttcggctcgtcgtggacgagtcgcccaagccccagacgtccggcccgggctag

SEQ ID NO: 150 - protein, 313 aa, Unknown
  Obtained from an environmental sample
MTKLEKVVAAAVQATPEFLDREATVEKAVRLIKEAAGEGAGLIVFPETFIPTYPDWVWRAPAWDGPSADLYAMLLENAVEIPGPVTETLGKAAKQAKAFVSMGVNEREPGGGTIYNTQVTFGPDGSVLGKHRKLMPTGGERLVWGMGDGSMLQVYDTPFGRLGGLICWENYMPLARYSMYAKGVDVYVAPTWDNSDMWVATLRHIAKEGRLYVIGVAPLLRGSDVPDDVPGKAELWGGDDDWMSRGFSTIVAPGGEVLAGPLTEEEGILYAEIDPARARSSRHQFDPVGHYSRPDVFRLVVDESPKPQTSGPG

SEQ ID NO: 151 - DNA, 993 bp, Unknown
  Obtained from an environmental sample
atgagagtcgttaaagccgccgcggtccaactgaaaccagtcctttatagccgtgagggaacagtcgataacgtcgtcaagaagatccacgagctgggccaacaaggagtgcagttcgcaacgttcccggaaaccgtggtgccttactatccgtacttttcgatcgtgcagtccggctatcaaatccttgccggcggtgagttcctaaagctgcttgatcagtcagtgaccgtgccatctcttgccaccgaagcgatcggcgaggcctgcaggcaagcgggcgtcgttgtctccatcggcgtcaacgagcgtgacgggggaactctgtacaatacgcaacttctctttgatgccgacggcacgttgattcaaagacgacgcaagatcacgcccacccattacgagcgcatggtctggggccagggcgatggctcaggtttacgggcggttgacagcaaggtcgcgcgcattggtcaactggcttgttttgagcactacaacccgcttgcgcgttacgccatgatggccgatggcgagcaaatccactctgcgatgttcccgggctccatgttcggcgatgcgttttcagagaaggtggaaatcaacgtaaggcagcatgcaatggagtctggatgctttgtcgtctgcgctacggcctggctggatgccgaccaacaggcacaaatcatgaaggacacaggctgcgagatcggtccgatctcgggcggttgcttcaccgctatcgtgacacccgacgggacgctgataggcgaacccatccactcgggcgaaggcgtttgtattgccgacctcgatttcaagctcatcgacaagcggaagcacgtggtggacacgcgcggccactacagccggccagaattgctcagcctcctaattgatcggactcccacggcacacatacacgaacggaacgagcaaccgaagtcggccgttgagcaagactcgcagaatgtattcaccgctattgcttaa

SEQ ID NO: 152 - protein, 330 aa, Unknown
  Obtained from an environmental sample
MRVVKAAAVQLKPVLYSREGTVDNVVKKIHELGQQGVQFATFPETVVPYYPYFSIVQSGYQILAGGEFLKLLDQSVTVPSLATEAIGEACRQAGVVVSIGVNERDGGTLYNTQLLFDADGTLIQRRRKITPTHYERMVWGQGDGSGLRAVDSKVARIGQLACFEHYNPLARYAMMADGEQIHSAMFPGSMFGDAFSEKVEINVRQHAMESGCFVVCATAWLDADQQAQIMKDTGCEIGPISGGCFTAIVTPDGTLIGEPIHSGEGVCIADLDFKLIDKRKHVVDTRGHYSRPELLSLLIDRTPTAHIHERNEQPKSAVEQDSQNVFTAIA

SEQ ID NO: 153 - DNA, 1074 bp, Unknown
  Obtained from an environmental sample
atgccaaacgcaagaaagattgttggagccgtggcccaagttgcacaggaattcttcgacactgaagcgaatctcggtaaagcgatagcggcgattcacaatgctgcgaagcaaggcgcagatatcgtcgtcttcgccgaatgctatttgggccaatatccatattgggcgcaattttacgacaactctgccaagaactattccaaggtttggacggccctgtacgacggtgcgatcactgtgggtggcgatgaatgccgggctattgctgctgcggctagacagtccaagattcatgtcgtcatgggttgcaatgagctatccgaccgagccggcggcgcaacgttatacaacagcctcttgtttttcgaccgaaagggcgagttgatcggtcgacaccggaaattgatgccgtcgatgcacgagcggttgatccatggcacaggcgacggaagagacttgaatgtttacgataccgatatcggtatgttgggtgggttgatttgctgggagcaccatatgtcgctctcgaagtatgccatggcgactatgggtgaagaagttcatgttgcaagctggcctgggatgtggcgcggaggagacgcggcaatcggtgagaggatggtcgaagcggatcttggggcgccgtttgtttgtgacgccgaatttgcgatccgagaatatgcggcagagacaggaaatttcgttctaagcgcgtctggatattttccgaaggacaatatatccgatgagtggcgcgaagcgattccaaaccttcaagcgcagtgggctgtgggcgggagttctatcgtggcaccggggggctcctatctggtcccaccactcattaatgaggagaagatcctctgcgccgaactcgatttcaatctcaggcgtctttggaaagcctggatcgatccgattggtcactattcgcgtcccgatgtttatagcctgcaactgcataacgttgctgggcgtgagtattcctatcaggccgtagatttgaagcgcacgccaaagccccaatcgctgtgggtagatgcgtccgaggaagacggtgcgctgaattga

SEQ ID NO: 154 - protein, 357 aa, Unknown
  Obtained from an environmental sample
MPNARKIVGAVAQVAQEFFDTEANLGKAIAAIHNAAKQGADIVVFAECYLGQYPYWAQFYDNSAKNYSKVWTALYDGAITVGGDECRAIAAAARQSKIHVVMGCNELSDRAGGATLYNSLLFFDRKGELIGRHRKLMPSMHERLIHGTGDGRDLNVYDTDIGMLGGLICWEHHMSLSKYAMATMGEEVHVASWPGMWRGGDAAIGERMVEADLGAPFVCDAEFAIREYAAETGNFVLSASGYFPKDNISDEWREAIPNLQAQWAVGGSSIVAPGGSYLVPPLINEEKILCAELDFNLRRLWKAWIDPIGHYSRPDVYSLQLHNVAGREYSYQAVDLKRTPKPQSLWVDASEEDGALN

SEQ ID NO: 155 - DNA, 1041 bp, Unknown
  Obtained from an environmental sample
atgggcatcgaacatccgaaatacaaggtggccgtggtgcaggccgcgccggcctggctcgatctcgacggctcgatcaagaaggcgattgcgctgatcgaggaagcggccgccaagggcgctaagctgatcgctttccccgaaaccttcattcccggctatccctggcacatctggctggactcgccggcctgggcgatcggccgcggctttgtgcagcgctacttcgataactcgctggcctacgacagcccgcaagccgaaaagctgcgcgccgcggtcaagaaggccaagctcactgccgtgattggcctgtcggagcgcgacggcggcagcctctatatagcgcaatggctgattggccctgatggcgagaccatcgcaaaacgcagaaagctgcggccaacgcacgcggaacgcaccgtttttggcgagggtgacggcagcgaccttgccgtgcacgaccggcccggaatcgggcggctgggagcgctgtgctgctgggagcacctgcaaccgctttcgaaatacgcgatgtatgcgcagaacgaacaggtccatgtcgcgtcatggccgagcttctcgctctacgaccccttcgcgccggcgctcggcgccgaggtcaacaatgcggcttcccgcgtctacgcggtcgagggctcgtgcttcgtgctggcgccgtgcgccacggtttcgcaagccatgatcgacgagctgtgtgaccggccggacaagcatgcgctgttgcacgccggtggcggacacgccgcgatttacggcccggacggcagctcgatcgcggagaagctgccgcaggacgcggagggcctgttgatcgccgagatcgatctcggggcgatcggggttgccaagaatgcagccgacccggccggtcattattcgcggccggacgtgacgcgactcctgctgaacaagaaccggatgcgaagggtcgaggagtttgcgctgccggtcgatccggtcgcaacgaccgaggaggagcaagtcgcgacgccgtcgaggcccagccaggccgcgtaa

SEQ ID NO: 156 - protein, 346 aa, Unknown
  Obtained from an environmental sample
MGIEHPKYKVAVVQAAPAWLDLDGSIKKAIALIEEAAAKGAKLIAFPETFIPGYPWHIWLDSPAWAIGRGFVQRYFDNSLAYDSPQAEKLRAAVKKAKLTAVIGLSERDGGSLYIAQWLIGPDGETIAKRRKLRPTHAERTVFGEGDGSDLAVHDRPGIGRLGALCCWEHLQPLSKYAMYAQNEQVHVASWPSFSLYDPFAPALGAEVNNAASRVYAVEGSCFVLAPCATVSQAMIDELCDRPDKHALLHAGGGHAAIYGPDGSSIAEKLPQDAEGLLIAEIDLGAIGVAKNAADPAGHYSRPDVTRLLLNKNRMRRVEEFALPVDPVATTEEEQVATPSRPSQAA

SEQ ID NO: 157 - DNA, 1011 bp, Unknown
  Obtained from an environmental sample
atgagagtcgttaaagctgctgcggtccaactgagtcccgtgctgtatagccgtgagggaacagtagaaaaggtcgttcggaagatccacgagcttggcgatcaaggagtcgagttcgccacgttcccggagaccgtagtgccctactatccgtacttctcggccgtccagacgccgattcagaacatgcacggcccggagcacctgaagttgctcgagcaatcggtgaccgtcccgtcgcccgccaccgacgcgatcggcgacgcctgccgccacgccggcgtcgtcgtctcgatcggcgtcaacgaacgcgatggcggcacgatctacaacacgcagctcctgttcgacgccgacggcaccttgatccagcgccggcgaaagatcacgccgaccttctacgaacgaatggtctggggacagggtgacggttcggggctgcgcgccgtcgacagccgcgtaggacgcatcggccagctcgcctgtttcgagcactacaacccgctggcgcgctacgccatgatggccgacggcgagcagattcactccgcgatgtaccccggctccatctttggagacgcattcgcgcagaaaatcgagatcaacatccgccagcacgcgctcgagtccggtgcgttcgtcgtcaacgccaccgcctggctcgatgccgaccagcaggcgcggatcatgaaggataccggctgcaccatcgaaccgatctcgggcggttgcttcaccgccatcgtcaccccggacgggaccctgctgggcgaagcgatacgttcgggggagggagtggtggtcgccgatctcgacttcacgctgatcgacaggcgcaagcaagtgatggactctcgtggtcactacagtcggccggagttgctcagccttctgatcgaccgcacacccaccgcacacctacacgaacgcgaagcgcaccccagagcaagtgaggactggcaaggttccgagagtctgcgcgccatgcaggcctcggcaccgaaggtctga

SEQ ID NO: 158 - protein, 336 aa, Unknown
  Obtained from an environmental sample
MRVVKAAAVQLSPVLYSREGTVEKVVRKIHELGDQGVEFATFPETVVPYYPYFSAVQTPIQNMHGPEHLKLLEQSVTVPSPATDAIGDACRHAGVVVSIGVNERDGGTIYNTQLLFDADGTLIQRRRKITPTFYERMVWGQGDGSGLRAVDSRVGRIGQLACFEHYNPLARYAMMADGEQIHSAMYPGSIFGDAFAQKIEINIRQHALESGAFVVNATAWLDADQQARIMKDTGCTIEPISGGCFTAIVTPDGTLLGEAIRSGEGVVVADLDFTLIDRRKQVMDSRGHYSRPELLSLLIDRTPTAHLHEREAHPRASEDWQGSESLRAMQASAPKV

SEQ ID NO: 159 - DNA, 930 bp, Unknown
  Obtained from an environmental sample
atgtcatcaaccgtgacggttgccattattcaggcagcacccgtgtattatgacctgcctgccacgctggacaaagccgccaaactggtggcggatgcggcggcacagggcgcaacgctgattgtcttcggcgagacatggtttccggggtatccggcatggctggattactgccccaatgtcgcgctgtggaatcatcccccgaccaagcaggtatttgagcgcctgcatcgcaacagcatcgctgtgccaagcaaggaactcgattttctgggggcgctggcacgcaagcatcaggtggtgctggtgttgagcattaatgaacgtgtggagcagggcgcggggcatggcacgctgtataacacgctgctcacgattgacgccgatggcacgctggcaaatcatcatcgcaaactgatgccgacctataccgagcgcatggtgtggggcatgggcgacggggtggggttgcaagcggtggatactgccgtcgggcgcgtaggcggcttaatctgctgggaacactggatgccgttggcacgccagaccatgcacatcagcggcgaacagattcatatttccgtcttcccaaccgtccatgagatgcaccagattgccagccgccagtatgcctttgaagggcggacgtttgtgctgaccgttggcggcattcttgcggcacaggacttgcccgccgaactggaacgccccgccgatttgccgcccacgcagcttgtccagcgcggcggcagcgccattatcgcgccggatggtcgttatctggcgggtccagtctataatgaggaaaccatcctgaccgcaacgctggatttgggcgagatcatccgcgagagcatgacgctggatgtcaccggacattatgcccgcccggatgtttttgacctgaccgtgaagcgcagccgaccatga

SEQ ID NO: 160 - protein, 309 aa, Unknown
  Obtained from an environmental sample
MSSTVTVAIIQAAPVYYDLPATLDKAAKLVADAAAQGATLIVFGETWFPGYPAWLDYCPNVALWNHPPTKQVFERLHRNSIAVPSKELDFLGALARKHQVVLVLSINERVEQGAGHGTLYNTLLTIDADGTLANHHRKLMPTYTERMVWGMGDGVGLQAVDTAVGRVGGLICWEHWMPLARQTMHISGEQIHISVFPTVHEMHQIASRQYAFEGRTFVLTVGGILAAQDLPAELERPADLPPTQLVQRGGSAIIAPDGRYLAGPVYNEETILTATLDLGEIIRESMTLDVTGHYARPDVFDLTVKRSRP

SEQ ID NO: 161 - DNA, 1008 bp, Unknown
  Obtained from an environmental sample
atgaccaccatccgcgccgccgccgtgcagtttagcccggtgctgtactcgcgccaggccaccgtcgacaagctgtgccgcaccctgctggaactgggccgcgaaggggtgcagttcgcggtattcccggaaaccgtggtgccgtactacccatatttttccttcgtgcagccaccgttcgccatgggcaaacaacacctgttgctgctcgagcaatccgtcactgtgccctctgacgtcacccggcagatcggtgaggcctgccgggaagcggggatcgtcgccagcatcggcgtcaacgaacgcgacggcggcactatttataacgcgcagttgctgttcgatgccgacggcagcctgattcagcagcggcgcaagatcaccccgacctatcacgaacgcatggtctgggggcagggcgatggttccggcctgcgcgccgtggacagtgcggtggggcgtatcggttccctggcctgctgggaacattacaaccccctggcgcgctacgcgctgatggccgatggcgaacagattcatgtggcgatgtttcccggctccctggtcggcgacatctttgccgagcagatcgaagtcaccatccgccaccacgccctggaaagcggctgcttcgtggtcaacgccacggcttggctggatgccgaccagcagggccggatcatgcaggacaccggctgcgagttggggccgatttccggcggctgttttaccgcgatcatttccccggagggcaaggttctcggcgagccgctgcgcagcggcgaaggggtggtcattgctgacctcgacctggccctgatcgacaagcgcaaacgcatgatggattcggtcggtcactacagccgcccggaactgctcagcctgcttatcgaccgcagcccgaccgcccacgtgcatgaacttgccgccgcgcttaatcctgccagggagtctgatccactagtgtcgacctgcaggcgcgcgagctccagcttttgttccctttag

SEQ ID NO: 162 - protein, 335 aa, Unknown
  Obtained from an environmental sample
MTTIRAAAVQFSPVLYSRQATVDKLCRTLLELGREGVQFAVFPETVVPYYPYFSFVQPPFAMGKQHLLLLEQSVTVPSDVTRQIGEACREAGIVASIGVNERDGGTIYNAQLLFDADGSLIQQRRKITPTYHERMVWGQGDGSGLRAVDSAVGRIGSLACWEHYNPLARYALMADGEQIHVAMFPGSLVGDIFAEQIEVTIRHHALESGCFVVNATAWLDADQQGRIMQDTGCELGPISGGCFTAIISPEGKVLGEPLRSGEGVVIADLDLALIDKRKRMMDSVGHYSRPELLSLLIDRSPTAHVHELAAALNPARESDPLVSTCRRASSSFCSL

SEQ ID NO: 163 - DNA, 978 bp, Unknown
  Obtained from an environmental sample
gtgaccatcatcaaagccgccgcagtgcagatcagccccgtgctttacagccgggaagccaccgtcgaaaaggtcgttcgcgagacccgcgaactcggccagaagggcgtgcagttcgcaacgtttccggaaaccgtggtgccgtactacccatacttctccgccgtccagacgggcatcgaactgctgtccggcaaagagcacctgcgactgctggagcaggccgtgactgttccttcccccgccactgatgcgattgcccaggcggcacgcgaggccggcatggtggtgtcgatcggcgtcaacgagcgtgacggcggcaccatctacaacacgcagctgctctttgatgccgacggcacgctggtgcagcgccgccgcaagatcacgccgacgcatttcgagcgcatggtgtggggccagggcgacggttcgggcctgcgcgcagtggataccaaggtcggccgcattggccagctggcctgcttcgagcacaacaacccgctcgcgcgctacgcaatgatggccgatggcgagcagatccattcctccatgtacccgggctccgccttcggcgacggattcgcgcagcgcatggagatcaacattcgccaacacgccctggagtcgggttgcttcgtggtgaatgccaccgcgtggctcgacgccgaccagcaggcgcagatcatgaaggacacgggctgcgccatcgggccgatctctggcggctgcttcacgaccatcgtcacgccggacggcatgctgatcggcgaacccctccgcgagggcgagggcgagatcatcgccgacctcgatttcaccctgatcgaccgccgcaagctgctgatggactcggtcggccactacaaccgtccggagctgctgagcctgctgatcgaccgcacacccgcggcgaacttccatgagcgcagtacgcatccggccgtcgatgccgccagcggcctcgaaatcctctaa

SEQ ID NO: 164 - protein, 325 aa, Unknown
  Obtained from an environmental sample
VTIIKAAAVQISPVLYSREATVEKVVRETRELGQKGVQFATFPETVVPYYPYFSAVQTGIELLSGKEHLRLLEQAVTVPSPATDAIAQAAREAGMVVSIGVNERDGGTIYNTQLLFDADGTLVQRRRKITPTHFERMVWGQGDGSGLRAVDTKVGRIGQLACFEHNNPLARYAMMADGEQIHSSMYPGSAFGDGFAQRMEINIRQHALESGCFVVNATAWLDADQQAQIMKDTGCAIGPISGGCFTTIVTPDGMLIGEPLREGEGEIIADLDFTLIDRRKLLMDSVGHYNRPELLSLLIDRTPAANFHERSTHPAVDAASGLEIL

SEQ ID NO: 165 - DNA, 1008 bp, Unknown
  Obtained from an environmental sample
atggccaatttcaaattcaaggcggcggcggtgcaggccgcgcccgctttcctcgatctcgaggctagcatcgccaagtcgatcgccctgatcgaacaagccgccgccaacggcgccaagctgatcgcctttcccgaagtcttcattcccggctacccctggcacatctggctcgacagtcccgcctgggcgatcgggcgcggcttcgtctcgcgctatttcgagaactcgctggactacaacagccccgaggccgagcgcctcaggctcgccgtcaagaaggcgggcctgacggcggtgatcggcctctccgagcgcgacggcggcagcctctacatcgcgcaatggatcatcggccctgacggcgagaccgttgcgaaacggcgtaagctccggccgacccattgcgagcgcacggtctatggagaaggcgacggcagcgacctcgcggttcacgacgtatctggcatcggccgtctcggcgcgctctgctgctgggagcatatccagccgctgtcgaaattcgcgatgtattcgcaaaatgagcaagtgcacgtcgcgtcctggccgagcttctcgctctacgacccgttcgcgccggcgctgggcgccgaggtcaacaacgcagcctcgcggatctatgcggtcgaaggctcatgcttcgtcattgcgccctgcgcgaccgtttcgcctgcaatgatcgaggaactgtgcgacgcgccaaacaaacatgcgcttctgcacgcgggcggcggcttcgcgcgcatctatgggccggacggcgcttcgatcgccgagacgctgccgccagatcaggaaggcttgatctacgccgacatcgacctcaccgcgatcggcgtcgccaaggccgccgccgatcccgccggccattattcgcgccccgacgtcacgcgcctgctcttcaacaagaagcccgctcggcgagtcgaaacttttgctttgcccgtcgatgcgccggcgccggagacgcagaccgccgcgagctga

SEQ ID NO: 166 - protein, 335 aa, Unknown
  Obtained from an environmental sample
MANFKFKAAAVQAAPAFLDLEASIAKSIALIEQAAANGAKLIAFPEVFIPGYPWHIWLDSPAWAIGRGFVSRYFENSLDYNSPEAERLRLAVKKAGLTAVIGLSERDGGSLYIAQWIIGPDGETVAKRRKLRPTHCERTVYGEGDGSDLAVHDVSGIGRLGALCCWEHIQPLSKFAMYSQNEQVHVASWPSFSLYDPFAPALGAEVNNAASRIYAVEGSCFVIAPCATVSPAMIEELCDAPNKHALLHAGGGFARIYGPDGASIAETLPPDQEGLIYADIDLTAIGVAKAAADPAGHYSRPDVTRLLFNKKPARRVETFALPVDAPAPETQTAAS

SEQ ID NO: 167 - DNA, 1017 bp, Unknown
  Obtained from an environmental sample
atgggtattgaacatccgaagtacagggttgccgtggtgcaggccgcaccggcctggctcgatcttgacgcgtcgatcgacaagtcgatcgcgctgatcgaggaggctgcccagaaaggcgccaagctgatcgcattccccgaggccttcatccccggctacccctggcatatctggatggactcgcccgcctgggcgattggccgcggttttgtgcagcgctacttcgacaattcgctggcctatgacagcccgcaggccgagaagctgcgcgcggccgtgcgcaaggcaaaactcacggccgtgatcggcttgtcggagcgtgacggcggcagcctttatctcgcacaatggctgatcggccccgacggcgagaccatcgcaaaacggcgcaagctgcggccgacacatgccgagcgcactgtgtacggcgagggcgacggcagcgaccttgcggtccacaatcgtccggacatcggcaggctcggtgcgctctgctgctgggagcatcttcagccactgtcgaaatacgcgatgtacgcgcagaacgagcaggtgcacgtcgcggcctggccgagcttttcgctctacgatcccttcgccgtggcgctcggcgccgaggtgaacaacgcggcctcccgcgtctatgcggtcgaaggctcctgcttcgtgctggcgccgtgcgcgacagtctcgcaagccatgatcgacgagctctgcgatcggccggacaagcacgcgctgctgcatgtcggcggcggctttgccgcgatctacgggcccgacggcagccagatcggcgacaagctcgcccccgaccaggagggcctgttgatcgccgagatcgatctcggcgccataggtgtcgccaagaacgccgcggatcccgccgggcactattcgcggcccgacgtgacgcggctgttgctcaacaagaaaccgtacaagcgcgtcgaacagttctcgccgccgtcggaggcggttgaacccacggatatcgcggcggcggcaagctga

SEQ ID NO: 168 - protein, 338 aa, Unknown
  Obtained from an environmental sample
MGIEHPKYRVAVVQAAPAWLDLDASIDKSIALIEEAAQKGAKLIAFPEAFIPGYPWHIWMDSPAWAIGRGFVQRYFDNSLAYDSPQAEKLRAAVRKAKLTAVIGLSERDGGSLYLAQWLIGPDGETIAKRRKLRPTHAERTVYGEGDGSDLAVHNRPDIGRLGALCCWEHLQPLSKYAMYAQNEQVHVAAWPSFSLYDPFAVALGAEVNNAASRVYAVEGSCFVLAPCATVSQAMIDELCDRPDKHALLHVGGGFAAIYGPDGSQIGDKLAPDQEGLLIAEIDLGAIGVAKNAADPAGHYSRPDVTRLLLNKKPYKRVEQFSPPSEAVEPTDIAAAAS

SEQ ID NO: 169 - DNA, 1077 bp, Unknown
  Obtained from an environmental sample
atggccctcacccatccgaaattgaaagtcgccgccgtgcaggcagctcccgcgttcctcgatgtcgatgccgcagtggacaaagcggtgcggctaatcgacgaagcggcagcaaacggctccagtctggtggcattccccgagacctggatccccggctatccgttttggatctggcttggctcgccggcctgggcaatcatgcgcgggtttgtgtctcgctatttcgataattcgctcagctatgacagccggcaggcagagcgcctgcgcgacgccgcgaagcgccacaaactgaccgtcgtcatgggcctgtccgagcgcgccggcggtagcctttacatcgcgcagtggatcattggtcccaatggcgagaccgtcgcacagcggcgcaagctcaagcccacccatgcggagcgcaccgtcttcggcgagggtgacggcagccacctggcggtacacaatcttccaatcggacggctcggtgcgctgtgctgctgggagcacctccagccgctctccaaatacgcgatgtacgcccagaacgaagagatccacgtggcggcatggccgtccttctcgctctacgacccgtttgcgcacgcgctcggcgccgaagtcaacaacgcagcgagccagatctacgcggttgaaggttcctgctttgtcgtcgcgccatgtgcggtgatctcgcaggaaatgatcgatcttatgtgcgatacccccgacaagcatcagcttattcacgtcggtggcggcttcaccgtgatctatggcccggacggtgcgcgcatcggcgacaagctcgcgccagatcaggaaggcattgtctatgccgacatcgatctcggcatgatcccgatcgcgaaagctgccgccgatcctgccggccactatgcgcgacccgacgttacccgccttctgttcaacaatcgtcccgccaatcgggtggaaaccctcgtgctccccgttgatcaggtccgtgacatcgatgcacgtgtggaggccgcggcacctcaggcgcgaccagcaaccgggaacgaggatcccgccgcaaagcctatggccgccgaatga

SEQ ID NO: 170 - protein, 358 aa, Unknown
  Obtained from an environmental sample
MALTHPKLKVAAVQAAPAFLDVDAAVDKAVRLIDEAAANGSSLVAFPETWIPGYPFWIWLGSPAWAIMRGFVSRYFDNSLSYDSRQAERLRDAAKRHKLTVVMGLSERAGGSLYIAQWIIGPNGETVAQRRKLKPTHAERTVFGEGDGSHLAVHNLPIGRLGALCCWEHLQPLSKYAMYAQNEEIHVAAWPSFSLYDPFAHALGAEVNNAASQIYAVEGSCFVVAPCAVISQEMIDLMCDTPDKHQLIHVGGGFTVIYGPDGARIGDKLAPDQEGIVYADIDLGMIPIAKAAADPAGHYARPDVTRLLFNNRPANRVETLVLPVDQVRDIDARVEAAAPQARPATGNEDPAAKPMAAE

SEQ ID NO: 171 - DNA, 1011 bp, Unknown
  Obtained from an environmental sample
atgactaagggaacagtgaaagtcgcggcggcgcaggtcacccccgtgttcatggatcgtaaagccacgatcgtcaaggcctgcgacacgatcgccgaggcgggcaagaacggcgcgcggctggtggtgttcccggagacgtttgttcctggctacccggactgggtctggacggcgacggctgggacgcatcgcgatatccaccaggcgatgtacgcggaactgctggaccaggctgtctcgattccgagcccggcgacggacgccctctgccgtgctgcaaagaaggcgggcgtctacgtcgtcatcggcgtcaatgagctgagtgggccgggcggaagcctgtacaacacgctgatctacatcgatgacgaaggcgagatcatgggccgccaccgcaagctggtccccacgatgggcgagcgcctggtctgggcacccggcgacggcagcacgctggaggcgtacgagacatcgatcggcaggctgggcggactgatctgctgggagaactacatgccgctggcccgctacgccatgtacgcctggggcgtgcagatctacgtcgcgccgacgtgggacagctcggacgggtgggttggcagcatgcagcacatcgcccgcgaagggcggacggcggtgatcggctgctgcatggcgatccgtcgcagcgacatcccggacaagtacgagttcaagaagctgtacccgccgagcaagagcaaagacgaagaatgggtgaacgatggcaacagcgtcatcgtcgcacccggtggacgaatactcgccgggccggtcgccaaagaggagacgatcctctacgccgatctggacccggcagccgagcgcggttcaaagttctcgttagatgtggcagggcactacgcgcggccggacgtcttccagctgacggtgaatcgcggtccggcagaactggtgaatgtggccggtgatatcgcaccggcaaccaacggcaaagtcaaaacaccggcgaaattacgccgcaagtaa

SEQ ID NO: 172 - protein, 336 aa, Unknown
  Obtained from an environmental sample
MTKGTVKVAAAQVTPVFMDRKATIVKACDTIAEAGKNGARLVVFPETFVPGYPDWVWTATAGTHRDIHQAMYAELLDQAVSIPSPATDALCRAAKKAGVYVVIGVNELSGPGGSLYNTLIYIDDEGEIMGRHRKLVPTMGERLVWAPGDGSTLEAYETSIGRLGGLICWENYMPLARYAMYAWGVQIYVAPTWDSSDGWVGSMQHIAREGRTAVIGCCMAIRRSDIPDKYEFKKLYPPSKSKDEEWVNDGNSVIVAPGGRILAGPVAKEETILYADLDPAAERGSKFSLDVAGHYARPDVFQLTVNRGPAELVNVAGDIAPATNGKVKTPAKLRRK

SEQ ID NO: 173 - DNA, 993 bp, Unknown
  Obtained from an environmental sample
atgaaagttgttaaagccgccgcagtccaactgagtcccgtcctctatagccgcgagggaacggtcgagagggtcgttcggaagatccacgagcttggccggcagggggtacagttcgccaccttcccggagaccgtagtgccttactacccgtacttttccttcgtccagacgcccttacagattatagccggacctgagcatctaaagctgctcgaccaggcagtgaccgtgccgtcccctgccaccgacgctatcagcgaggctgccaggcaggcgggagttgtggtgtccataggcgtcaacgagcgtgacggcggaaccctgtacaacacgcagctgctcttcgatgccgatggcgccttgatccagcgccgccgcaagattacgcccactcatttcgagcgcatgatctggggccagggcgacgggtcgggcctgcgcgctgtcgacagcaaggtcggtcgcattggccagctcgcatgctgggagcacaacaaccccctggcgcgctacgcgatgatagccgacggcgagcagatccattcggcaatgtatccgggctccatgttcggcgacccgtttgcccagaagacggaaatcaatatccggcagcatgcattggagtctgcgtgcttcgtcgtgtgcgccacggcctggctggacgccgatcagcaggcgcaaatctgcaaggacactggctgcgacatcggcccgatctccggcggttgcttcaccgcgatcgtggcgcctgatggaaccttgctgggcgagcccatccgctcgggcgaaggcatggtcatcgtcgacctcgacttcacgctcatcgacaagcgcaagcaggtgatggactcgcgcggccactacaaccggccggaattgctcagtctcctgatcgaccgcacacccactgcgcatgttcacgaccgcgctgtgcgccccgagtcagccgcggagcaacgttcggaggaacttctcgctacggctgtctaa

SEQ ID NO: 174 - protein, 330 aa, Unknown
  Obtained from an environmental sample
MKVVKAAAVQLSPVLYSREGTVERVVRKIHELGRQGVQFATFPETVVPYYPYFSFVQTPLQIIAGPEHLKLLDQAVTVPSPATDAISEAARQAGVVVSIGVNERDGGTLYNTQLLFDADGALIQRRRKITPTHFERMIWGQGDGSGLRAVDSKVGRIGQLACWEHNNPLARYAMIADGEQIHSAMYPGSMFGDPFAQKTEINIRQHALESACFVVCATAWLDADQQAQICKDTGCDIGPISGGCFTAIVAPDGTLLGEPIRSGEGMVIVDLDFTLIDKRKQVMDSRGHYNRPELLSLLIDRTPTAHVHDRAVRPESAAEQRSEELLATAV

SEQ ID NO: 175 - DNA, 945 bp, Unknown
  Obtained from an environmental sample
atgaccacctacgggcagtttagacttgccgcgatcaatgccgcgcctgtctacttcgacagggaagcatccaccgaaaaagcttgccggctcattctcgaagcgggggcatcaggggcgacgctggcggcgtttggcgagacgtggcttcccggctatccattccacatctggagggaagttccgactgctctccgagtggaatacatcgctaatgccgtcgagattcccagcccaacgaccgaccgattgtgcgcggcggctcgtcaggcgaacatcgatgttgtgatcggcgttgtcgaactggatgcgcagacacacgggacggtctactgtacgctcttgttcattggcagcgatggctcaattctgggacgtcatcgaaagattaaaccgactttcgtggagcgaaccgcatggggggaaggtgacggcagcagcctgatcgtctacgagcgcccgtatggcaagatcagtggtctgtgttgctgggaacacaatatggttctgccgggctacgcgctgatggcgcaggggacgcagattcatatcgccgcatggcccggctgggaaagcactcgccatctgctcttatcaagagcattcgcttctcaggcagcggcgtatgtgattgatgtaggcgctatcgtcaatcgtgacgaccttcgggaagattaccaggctttgattgctggaagctactggggcggaagttgcatcatcaacccagaaggcgaggtcatcgctggtccagcgaaatcggagaccattctggttgcagattgctcaaccgagcagatctttagctcaaaagtgctctgtgatgtgggcgggcattattctcgcccggatatttttcagctccatgtcaatcgaaagccatatcaacgtatcgtcgagacgaacaacccacaccccgctccgattgagttcgattaccgttga

SEQ ID NO: 176 - protein, 314 aa, Unknown
  Obtained from an environmental sample
MTTYGQFRLAAINAAPVYFDREASTEKACRLILEAGASGATLAAFGETWLPGYPFHIWREVPTALRVEYIANAVEIPSPTTDRLCAAARQANIDVVIGVVELDAQTHGTVYCTLLFIGSDGSILGRHRKIKPTFVERTAWGEGDGSSLIVYERPYGKISGLCCWEHNMVLPGYALMAQGTQIHIAAWPGWESTRHLLLSRAFASQAAAYVIDVGAIVNRDDLREDYQALIAGSYWGGSCIINPEGEVIAGPAKSETILVADCSTEQIFSSKVLCDVGGHYSRPDIFQLHVNRKPYQRIVETNNPHPAPIEFDYR

SEQ ID NO: 177 - DNA, 948 bp, Unknown
  Obtained from an environmental sample
atggactcacttaccgttggtctcgcgcaaatcgcgcccgtttggttgaatcgggcggggacgttgtcaaagatgttggaacaggttcgagcggcgaaagaggcgggctgtcagcttgttgtgtttggtgaggcgttgctccccggttatccattttggatcgaactgacgaacggcgcagtcttcaattcgccgatgcaaaaggaaatccacgcgcactacatggatcaagctgtgcagatcgaagcagggcatcttgatccattgtgcggcgcggcaaaagcgcacggcatcaccgtggtcgcgggcatcatcgagcgtccgttggatcgcggcggacatagtttatatgcgagtctggtgtatatcgatttgaacggtgtcatccaatcggtgcatcgcaaactgatgcccacctatgaagaacgactcacctggtcgcctggcgatggtcatgggttacgcgtgcatacactgggcgcttttacggttggcaaactcaattgttgggaaaactggatgccgctgccgcgcgcggctctgtatgcgcaaggcgaagatctgcacgttgctgtctggcccgggtccgtgcgcaacacacaggatattacgcgctttatcgcaatggagtcgcgatcgtttgtcgtttcggtttcgagtttgatgcgcaagagtgacttcccacaagatacgcctcatctctccgccattcttgaatctgcacccgatccactcgccaacggaggttcgtgtctggctggacctgacggtaaatggatcgttgaaccggttgcggatgaagagaagttgatcgtcgccaccattgaccatgcccgtgtacgtgaagaacgccagaactttgatccatccggtcattacagccgaccagatgtgacacaattgagagtcaaccgccagcgacaaagcgttatcgcttttgatgagtag

SEQ ID NO: 178 - protein, 315 aa, Unknown
  Obtained from an environmental sample
MDSLTVGLAQIAPVWLNRAGTLSKMLEQVRAAKEAGCQLVVFGEALLPGYPFWIELTNGAVFNSPMQKEIHAHYMDQAVQIEAGHLDPLCGAAKAHGITVVAGIIERPLDRGGHSLYASLVYIDLNGVIQSVHRKLMPTYEERLTWSPGDGHGLRVHTLGAFTVGKLNCWENWMPLPRAALYAQGEDLHVAVWPGSVRNTQDITRFIAMESRSFVVSVSSLMRKSDFPQDTPHLSAILESAPDPLANGGSCLAGPDGKWIVEPVADEEKLIVATIDHARVREERQNFDPSGHYSRPDVTQLRVNRQRQSVIAFDE

SEQ ID NO: 179 - DNA, 915 bp, Unknown
  Obtained from an environmental sample
atgaccaccaaagcagccatcattcaggcgcgccccatatactacgatctggcggcgtgtgtcgataaggcgcttgccctcatcaccgaggcggcggcacgcggcgcgaacatcgtcacgctcggcgagacgtggctgccgggctatcccgcgtggctggatgtgtgcgtcgagatggggctgtgggatcacgcgccgaccaaagccgtctttcagcggctccatgccaacagcgtcaccatccccggcgcggagatcagccagttctgcgacatcgcccgccgccttagcatcgtgctggtgctcagcgtcaacgagcgcgtccgcaacaccttgttcaacaccctgctcacgattgacgagcgcggcgacatccgcaaccaccaccgcaagctgatgccgacctacactgagcgcatcgtctgggggcagggcgacggcgcgggcttacaggcggtcgagacggcaaccgggcgcgtcggcgggctgatctgctgggaacactggatgccgctggcacggcaggcgctgcacaacgccggggagcaaattcacgtttcggtcttcccgaccgtcaacgacccgcgccaccaagtcgccagccgccagtacgctttcgaggggcgctgcttcgtgctgaccgccggcagcatccagcgcgccgacgacctaccgccggaactgaccgtcaaggcgggcatcgcgccggatgatctggtgcagggcggcggcagcgccatcatcgcgccggacatgcgctacctcgccggaccctgcttcgacgaggaaaccatcctctacgccgacctcgacctgagcgagacgatccgcgagagcatgacgctggacgtgagcgggcattactcgcgccccgacgtgttcaccttcgaggttaatcggcagcggaaaatttag

SEQ ID NO: 180 - protein, 304 aa, Unknown
  Obtained from an environmental sample
MTTKAAIIQARPIYYDLAACVDKALALITEAAARGANIVTLGETWLPGYPAWLDVCVEMGLWDHAPTKAVFQRLHANSVTIPGAEISQFCDIARRLSIVLVLSVNERVRNTLFNTLLTIDERGDIRNHHRKLMPTYTERIVWGQGDGAGLQAVETATGRVGGLICWEHWMPLARQALHNAGEQIHVSVFPTVNDPRHQVASRQYAFEGRCFVLTAGSIQRADDLPPELTVKAGIAPDDLVQGGGSAIIAPDMRYLAGPCFDEETILYADLDLSETIRESMTLDVSGHYSRPDVFTFEVNRQRKI

SEQ ID NO: 181 - DNA, 990 bp, Unknown
  Obtained from an environmental sample
atgcccaagaccgtacgcgcagccgcagtccagatcgcgcccgacctgacgtcacgcgctggcaccgtcgagcgggtcctgaatgcgattgccgaagcctctgacaaaggcgcggagctgattgtatttccagaaacctttgtgccttggtatccgtatttcagcttcgttctgccgcctgtccagcagggacccgagcacctgcggctttatgaagaagcggtgacggtaccatcagcagaaacacgggccgtcgccgacgccgcgcgcaaacgcaatgcggtcatcgtccttggcgtcaatgagcgcgaccacggctcgctctacaacacccagctgatcttcgacgcggatggcagcctgaaactcaagcgccgcaagatcacgcccacctatcacgagcggatgatctggggacagggcgatggcgccggtctaaaagtggtcgaaactgccatcggccgcatgggcgcattggcgtgctgggagcactacaaccccctcgcccgatacgcgctgatggctcagcatgaggaaattcacgcctctcattttccgggctcactggtcggcccgatattcggcgagcagatcgaagtcacgatgcgccaccacgcgttggaatcgggctgtttcgtggtcaatgccaccggctggttaagcgaggagcagatcgcgtccattcacccagatcccagcctgcagaagggtcttcgagatggctgcatgacctgcatcataaccccggaaggccgccacgtcgttcctcctctgacatcgggtgaaggaatcctgattggcgacctggacatgcggctcatcaccaagcgcaagcgaatgatggattccgtcggacactatgcacgtcctgagctgctgcaccttgtccatgacacgacgcccgcacgcgcacgcgagcaggtgggcctttcaggcgatttttccgatgcagggcaagacaagctatttgaggaggttcaagatgcgtga

SEQ ID NO: 182 - protein, 329 aa, Unknown
  Obtained from an environmental sample
MPKTVRAAAVQIAPDLTSRAGTVERVLNAIAEASDKGAELIVFPETFVPWYPYFSFVLPPVQQGPEHLRLYEEAVTVPSAETRAVADAARKRNAVIVLGVNERDHGSLYNTQLIFDADGSLKLKRRKITPTYHERMIWGQGDGAGLKVVETAIGRMGALACWEHYNPLARYALMAQHEEIHASHFPGSLVGPIFGEQIEVTMRHHALESGCFVVNATGWLSEEQIASIHPDPSLQKGLRDGCMTCIITPEGRHVVPPLTSGEGILIGDLDMRLITKRKRMMDSVGHYARPELLHLVHDTTPARAREQVGLSGDFSDAGQDKLFEEVQDA

SEQ ID NO: 183 - DNA, 1002 bp, Unknown
  Obtained from an environmental sample
atggctgagtcacgcattattcgtgccgccgccgcccagattgcgccagatctccatgaggccagcaaaacgctggcccgggtgctggacgcgatcgatcaggcagccgcacagggggcagagatcatcgtctttcccgagacctttgtgccttattacccctacttctcgtttatcacgcccgcgatgaccgccggagcggcccatctgaaattgtatgaccaggcggtggtggtgcccggcccgatcacccatgcggtgggcgaacgcgcccgcctgcgcaacatcgtcgtggtgctgggggtgaatgaacgtgaccacggcacgctctacaacacccaactggtatttgatgccagcggggaactggtgctgaaacgccgcaaaatcaccccgacctatcacgaacggatgatctggggacagggagacggtgccggattaaaggtggtggactcggcggttgggcgcatcggggctttagcctgctgggagcactacaacccactggcgcgctacagcctgatgactcagcacgaggagatccattgcagccagttccctggttcactggtggggccgatttttgccgagcagatggacgtcaccattcgccatcatgcactggagtccggttgctttgtcatcaatgccaccggctggctgaccgaggagcagatcaacgagctgaccagcgacccggcgttacaaaaggggctgcgtggtggctgcaacaccgccatcatctcgccggaaggccgccatctggtgccgccactgaccgaaggtgaggggattttgattgccgatctggacatggccctgatcaccaaacgcaaacgcatgatggattctgtcggccactatgcccgaccggaattactcagcctgcgcctcgatgcgacgcctgcccgttatgtggtggcgcgtgataatgagtccgaaaccggaggaggcaacgatgcagaacgtaccgtctacgcgccagcagctgatcactga

SEQ ID NO: 184 - protein, 333 aa, Unknown
  Obtained from an environmental sample
MAESRIIRAAAAQIAPDLHEASKTLARVLDAIDQAAAQGAEIIVFPETFVPYYPYFSFITPAMTAGAAHLKLYDQAVVVPGPITHAVGERARLRNIVVVLGVNERDHGTLYNTQLVFDASGELVLKRRKITPTYHERMIWGQGDGAGLKVVDSAVGRIGALACWEHYNPLARYSLMTQHEEIHCSQFPGSLVGPIFAEQMDVTIRHHALESGCFVINATGWLTEEQINELTSDPALQKGLRGGCNTAIISPEGRHLVPPLTEGEGILIADLDMALITKRKRMMDSVGHYARPELLSLRLDATPARYVVARDNESETGGGNDAERTVYAPAADH

SEQ ID NO: 185 - DNA, 1017 bp, Unknown
  Obtained from an environmental sample
atgggcattgaacatccgaaatacaaggtcgcggtggtgcaggcggcccccgcctggctcgatctcgacggctcggtcgataagtcgatcgcgctgatcaaggaggcggccgagaagggggcgaagctgatcgcctttcccgaggccttcatccccggttacccctggcatatctggatggactcgccggcctgggcgatcggccgcggcttcgtgcagcgttatttcgacaattcgctgtcctatgacagtccgcaggccgagcggctgcgcgatgcggtgaagaaggcgaagctcaccgccgtgttcggactgtccgagcgcgacggcggcagcctctacctcgcgcaatggctgatcgggcccgatggcgagaccatcgccaagcgccgcaagctgcggccgacccacgccgaacgtaccgtctatggcgaaggcgacggcagcgatcttgccgtgcatgcgcgcgccgacatcggccggatcggcgcgctctgctgctgggagcatctgcagccactgtcgaaatacgcgatgtacgcccagaacgaacaggtccatgtcgcagcctggcccagcttctcgctgtacgaccccttcgcgccggcgttaggggccgaggtcaacaacgcggcctcccgcgtctatgcggtggaaggctcctgcttcgtgctcgcgccgtgcgcgacggtgtcgcaggcgatgatcgacgagctctgcgaccggcccgacaagaacgcgctgctgcacgtcggcggcggctttgccgcgatctatggccccgacggcagccagatcggcgacaagctggcgccggaccaggaggggctgctgatcgccgagatcgaccttggcgccatcggtgtcgccaagaacgccgccgatcccgccgggcactattcgcgtcccgacgtgacgcggttgctgctcaacaagaagcgataccagcgcgtcgagcagttcgcgctgccggtcgacaccgtcgagccggcggatatcggcgcagcggcgagctga

SEQ ID NO: 186 - protein, 338 aa, Unknown
  Obtained from an environmental sample
MGIEHPKYKVAVVQAAPAWLDLDGSVDKSIALIKEAAEKGAKLIAFPEAFIPGYPWHIWMDSPAWAIGRGFVQRYFDNSLSYDSPQAERLRDAVKKAKLTAVFGLSERDGGSLYLAQWLIGPDGETIAKRRKLRPTHAERTVYGEGDGSDLAVHARADIGRIGALCCWEHLQPLSKYAMYAQNEQVHVAAWPSFSLYDPFAPALGAEVNNAASRVYAVEGSCFVLAPCATVSQAMIDELCDRPDKNALLHVGGGFAAIYGPDGSQIGDKLAPDQEGLLIAEIDLGAIGVAKNAADPAGHYSRPDVTRLLLNKKRYQRVEQFALPVDTVEPADIGAAAS

SEQ ID NO: 187 - DNA, 1059 bp, Unknown
  Obtained from an environmental sample
atgggcatcaatcatcccaagtacaaagtggccgtcgtgcaagcggcacctgtctggctcgacctggatggaacagtcgacaagtgcattcggctgataggcgaggccgctgagaagggatgcaagctcattgcatttcccgagacgttcatcccggggtacccctggcacatctggatgggagctccggcctggacgatcgggcgcggattcgtgcagcgatacttcgacaattcgcttgcgtacgacagtccgcaggcaaacaagcttcgcgccgcggtgaagcgcgccggagtgacggcagttctcggcttgtcggagcgccgcggaggctccctgtacatcgcccagtggctcatcggacctgatggcgagaccatcgctcaacggcgaaagctgcgccccacccatgcggagcgcaccgtcttcggcgagggcgatggcagcgatttggcggtgcacagccgccccgacatcggccgactgggtgccctttgctgctgggaacatctccagcctttgaccaagtacgcgatgtacgcgcaagacgagcaagtgcacgtcgctgcatggccgagcttctcgatgtacgagcctttcgcgcacgccctggggtgggagacgaacaacgcggtgagcaaggtgtacgcggtcgaaggttcgtgctacgtcctggccccctgcgccatcatctctcaggcgatggtggacgaactcgtcgacagcgaggacaagaagccgctggttcatgccggcggggggcatgcggtgatctatggtcccgatggcaccctgcttactcccaagcttgcagaagacgaggagggcctactgatcgcggagatcgatctgggggcaatcggggtcgccaagaacgcggcagaccccgccggccactactcgcggcccgatgtcacccgcctgctcttcaacaaccggccggccaagcgcgtggagacgatgctgctcccggtcgacgcggcagaagtcgtggagccggcggacggagcgctcaatgcgtccgagggacgccagcgacagttcaagctgcccgcctag

SEQ ID NO: 188 - protein, 352 aa, Unknown
  Obtained from an environmental sample
MGINHPKYKVAVVQAAPVWLDLDGTVDKCIRLIGEAAEKGCKLIAFPETFIPGYPWHIWMGAPAWTIGRGFVQRYFDNSLAYDSPQANKLRAAVKRAGVTAVLGLSERRGGSLYIAQWLIGPDGETIAQRRKLRPTHAERTVFGEGDGSDLAVHSRPDIGRLGALCCWEHLQPLTKYAMYAQDEQVHVAAWPSFSMYEPFAHALGWETNNAVSKVYAVEGSCYVLAPCAIISQAMVDELVDSEDKKPLVHAGGGHAVIYGPDGTLLTPKLAEDEEGLLIAEIDLGAIGVAKNAADPAGHYSRPDVTRLLFNNRPAKRVETMLLPVDAAEVVEPADGALNASEGRQRQFKLPA

SEQ ID NO: 189 - DNA, 1005 bp, Unknown
  Obtained from an environmental sample
atgcaagacacgaaattcaaagttgcagtcgtccaggccgcgccggtattcatggatgcgccagcctccgtggccaaggcgatcggtttcatccaggaggcgggcgcagccggggcgaagctgctggcgttcccggaggtctggattccgggctacccttggtggctttggctcgggacgccggcgtggggaatgcagtttgtgccgcgctatcacgccaattcgctgcgtgctgatggacccgaaatcctcgctctttgtgcggccgccgccgaagcgaagatcaacgtcgtgatgggcttctccgaaatcgacggaggaacgctctacctaagtcaggttttcatcagcgatgcgggcaagatcatcttcaagcgccgaaagctcaagccgacccacgtcgaacgtacgctatttggtgaaggagatgggtctgatttccgagtcgtcgacagcagcgtcgggcgcctcggagccctgtgctgtgccgaacacattcagccgttgtcgaaatacgccatgtacgcgatgaacgagcaaattcatgtggcgtcgtggccatctttcacgctctatcgcggcaaagcctacgctttgggtcatgaggtgaatcttgccgccagccaaatctacgcgctcgaaggaggttgcttcgtcttgcatgccacggcaattaccggtcaggatatgttcgacatgctttgcgacactccggaaagggcggatttgctgaatgcggagggagcaaagccgggtggaggctattcgatgatttttggtcccgatggtcagccgatgtgcgagcatctgccgcaggacaaggaaggcatcctctatgccggcgtagacctgtcgatgattgcgatcgccaaagcggcctacgatcctacggggcactacgcccgcggtgatgtcgtccgtctcatggtcaaccgcagcccccgtcgcacgagcgtcagcttcagcgaagacgagaacgcggcggtcactttcaccgagacctga

SEQ ID NO: 190 - protein, 334 aa, Unknown
  Obtained from an environmental sample
MQDTKFKVAVVQAAPVFMDAPASVAKAIGFIQEAGAAGAKLLAFPEVWIPGYPWWLWLGTPAWGMQFVPRYHANSLRADGPEILALCAAAAEAKINVVMGFSEIDGGTLYLSQVFISDAGKIIFKRRKLKPTHVERTLFGEGDGSDFRVVDSSVGRLGALCCAEHIQPLSKYAMYAMNEQIHVASWPSFTLYRGKAYALGHEVNLAASQIYALEGGCFVLHATAITGQDMFDMLCDTPERADLLNAEGAKPGGGYSMIFGPDGQPMCEHLPQDKEGILYAGVDLSMIAIAKAAYDPTGHYARGDVVRLMVNRSPRRTSVSFSEDENAAVTFTET

SEQ ID NO: 191 - DNA, 945 bp, Unknown
  Obtained from an environmental sample
atgaaaaagttagctgtggttcaacgtgcgtcaggatttttagataagcagcagagcatcgcgttggcggtggaaagtattcagtctgctgcgaataatggcgcagagcttgttgtttttacggaagcctttattcctggttatcctgtctggttatggcgtctgcgccctggcaaagactgggggacaacagacagtctttatcaacgcttaataagcaacgcggttgatttaagctcatcggatttggatccgatttatgaagcggcaaaacgtcatcacgtcacggttgtatgcggcattaatgaacgcgactccagcgtcagccgaacaacgctatacaacacttacatcacggtttgtcatgagggcaatctcatcaatgttcatcgaaaactgatgccgaccaacccagagagaatggtgtggggctttggtgatgcgactggattaagggtagtagacactcctgtcggaaggattggctcactcgtttgctgggagaactacatgccgttggcacgctatgcactttatgctcagggcgtcgaaatttacattgcgcctacttatgacagtggctcggactggactgaaagcttgcgccatatcgccagagagggcagatgctacgttgtcggcagcggtaacttgttgagagccagcgacctgcctgatgattttccagaaaaagaaaccctctatcctgataaagacgagtggattaacggcggagactctaccgttatcgctcccggcggtgaaacattagttgctccgctgcatgcagaggaaggcatactgtattgcgatattgatactgataaagtggcggcggctcggcgttctttcgacgttgcaggccattactctcgcccagacatatttacactcaacgtaaatcgagcgccgcaaacatctctgcgtatcagggaagccgagtaa

SEQ ID NO: 192 - protein, 314 aa, Unknown
  Obtained from an environmental sample
MKKLAVVQRASGFLDKQQSIALAVESIQSAANNGAELVVFTEAFIPGYPVWLWRLRPGKDWGTTDSLYQRLISNAVDLSSSDLDPIYEAAKRHHVTVVCGINERDSSVSRTTLYNTYITVCHEGNLINVHRKLMPTNPERMVWGFGDATGLRVVDTPVGRIGSLVCWENYMPLARYALYAQGVEIYIAPTYDSGSDWTESLRHIAREGRCYVVGSGNLLRASDLPDDFPEKETLYPDKDEWINGGDSTVIAPGGETLVAPLHAEEGILYCDIDTDKVAAARRSFDVAGHYSRPDIFTLNVNRAPQTSLRIREAE

SEQ ID NO: 193 - DNA, 966 bp, Unknown
  Obtained from an environmental sample
atgtcaaacgagaaccacaaccaaacattcaaagttgccgcggtgcaggccacacctgtattcctcgatcgtgaagcgaccatcgacaaagcttgtgagttgattgctgcagccggcaatgaaggagcgcggctggttgtcttcccggaggcattcatcccatcctacccagattgggtatgggcaatcccaccgggcgaagaaggcgtgctcaatgagttgtacgcggaactgctctccaattcggtcacgattcccagtgatgtgacggatagactgtgccgagccgcgagacttgccaatgcctacgtagtgatggggatgagcgaacgcaatgccgaggccagtggcgcaagcctgtataacacgctgttgtacatcgatgcgcagggcgagattctgggcaaacatcgaaagctggtgcccacaggcggcgaacggctggtgtgggcgcagggcgatggcagcacgctgcaggtctacgatactccactgggtaaactcggcggtttgatttgctgggagaattatatgccgctggcccgctacaccatgtacgcatggggcacacaaatctatgttgcggcgacatgggatcgcgggcaaccctggctctccactttacggcatatcgccaaagaaggcagggtgtacgtgatcggctgctgtatcgtgatgcgcaaagacgatatcccagatcgttacccgatgaagcagaagttttacgcggaggccgatgagtggatcaacataggggacagcgcaatcgtcaatcctgaagggcagtttagcgccgggccggtacgcaaacaggaagagattctctacgcggaaattgatccgcgcatggtgcaaggcccgaagtggatgctcgacgtagcagggcactacgcgaggccggacgtattccagttgacggtgcatacggatgcgaggcagatgatcaggttggaacacgatgtttaa

SEQ ID NO: 194 - protein, 321 aa, Unknown
  Obtained from an environmental sample
MSNENHNQTFKVAAVQATPVFLDREATIDKACELIAAAGNEGARLVVFPEAFIPSYPDWVWAIPPGEEGVLNELYAELLSNSVTIPSDVTDRLCRAARLANAYVVMGMSERNAEASGASLYNTLLYIDAQGEILGKHRKLVPTGGERLVWAQGDGSTLQVYDTPLGKLGGLICWENYMPLARYTMYAWGTQIYVAATWDRGQPWLSTLRHIAKEGRVYVIGCCIVMRKDDIPDRYPMKQKFYAEADEWINIGDSAIVNPEGQFSAGPVRKQEEILYAEIDPRMVQGPKWMLDVAGHYARPDVFQLTVHTDARQMIRLEHDV

SEQ ID NO: 195 - DNA, 993 bp, Unknown
  Obtained from an environmental sample
atgaaagtcgtcaaagccgccgcggtacagttcagcccggtgctctatagccgtgaggcaaccgtcgccaaggtcgtgcagaagatccacgaactcggccagaaaggcgtgcagttcgccaccttccccgaaacggtcgtgccttattacccttactttgcggccgtccagacgggcatcgagcttctctcgggcaccgaacatctgcgcctgctcgaacaggctgtgactgtcccgtccgctgctaccgacgcgatcggcgaagccgcgcgaaaggccggcatggtcgtgtccattggcgtcaatgagcgcgatggcggcacgctgtacaacgcacaactgctcttcgatgccgacggtacgctgatccagcgccgccgcaagatcacgccgacgcatttcgaacgcatgatctggggccagggagatggctcgggcttgcgtgcagtcgacagcgccgtcggccgcgtcggccagctcgcatgtttcgagcacaacaacccgctcgcccgctacgcaatgatcgccgacggcgagcagatccattcggcgatgtaccctggctcggcctttggcgagggcttcgcccagcgtatggaaatcaacatccgccagcatgcgctcgagtccgccgctttcgtcgtcaacgcaacagcgtggctggacgccgaccagcaggcgcaaatcatgaaggacaccggttgtggaatcggtccgatcacgggcggctgcttcaccacgatcgtctctcctgacggcatgctgatggccgagccgcttcgctcgggtgaaggcgaagtgatcgtcgatctcgacttcacgcagatcgaccgccgcaagatgctgatggactcggccggccactacaaccgccctgaactgctgagtctgatgatcgaccgtacgccgaccgcgcatgttcacgaacgcgcttcgcacccgatgatcgtcaacgaccagggttccgacgatctgcgcacccaggctgcatga

SEQ ID NO: 196 - protein, 330 aa, Unknown
  Obtained from an environmental sample
MKVVKAAAVQFSPVLYSREATVAKVVQKIHELGQKGVQFATFPETVVPYYPYFAAVQTGIELLSGTEHLRLLEQAVTVPSAATDAIGEAARKAGMVVSIGVNERDGGTLYNAQLLFDADGTLIQRRRKITPTHFERMIWGQGDGSGLRAVDSAVGRVGQLACFEHNNPLARYAMIADGEQIHSAMYPGSAFGEGFAQRMEINIRQHALESAAFVVNATAWLDADQQAQIMKDTGCGIGPITGGCFTTIVSPDGMLMAEPLRSGEGEVIVDLDFTQIDRRKMLMDSAGHYNRPELLSLMIDRTPTAHVHERASHPMIVNDQGSDDLRTQAA

SEQ ID NO: 197 - DNA, 1017 bp, Unknown
  Obtained from an environmental sample
atgggcatcgaacatccaaaataccgcgttgccgccgtgcaggctgcgccggcctggctcgacctcgatcgctcgatcgacaaggctattgcactgatcgaggaggccgccgcgaacggcgccagattgatcgcattcccggaggtcttcatccccggctacccctggcatatctggctcgactcgccggcctgggcgatcggccgcggcttcgtgcagcgttatttcgacaattcgctcgcttatgatagtccgcaggccgagcggctccgcgcagcggtccgcaaggcgcgcctgaccgccgtgatcggcctttcggagcggagcggcggcagcctctacatcgcgcaatggctcgttggccccgacggcgagaccatcgcgaagcgccgcaagctccgtccgacgcatgccgagcgcacggtctatggcgagggcgacggcagcgatctggcggtccatgaccggcccgatatcggacggctcggcgcgctgtgctgctgggaacatctgcaaccgttgtcgaaatatgcgatgtatgcccagaacgagcaggtccatgtggcgtcatggccgagtttttcgctctacgatccctttgccccggcgctcggcgcggaggtgaacaatgcggcctcccgggtctatgcggtcgaaggctcctgcttcgtgctggcgccgtgcgcgaccgtctcgcaggccatgatcgatgagctgtgcgaccggcccgacaagcacgcgctgctccatgccggcggtggctttgccgcgatctacgggcccgacggcagttcgctggccgaaaagctcgcgccggaccaggagggcctgctttacgccgacatcgatctcggcgcgatcggcgtcgcgaagaacgccgccgacccggcagggcattattcgcggcccgatgtcacgcggctgctgctgaacaacaagccctacaagcgcgtggagcattttgctttgcccggcgataccgtggcgcctgccgatgtggatgcggcggcgagctga

SEQ ID NO: 198 - protein, 338 aa, Unknown
  Obtained from an environmental sample
MGIEHPKYRVAAVQAAPAWLDLDRSIDKAIALIEEAAANGARLIAFPEVFIPGYPWHIWLDSPAWAIGRGFVQRYFDNSLAYDSPQAERLRAAVRKARLTAVIGLSERSGGSLYIAQWLVGPDGETIAKRRKLRPTHAERTVYGEGDGSDLAVHDRPDIGRLGALCCWEHLQPLSKYAMYAQNEQVHVASWPSFSLYDPFAPALGAEVNNAASRVYAVEGSCFVLAPCATVSQAMIDELCDRPDKHALLHAGGGFAAIYGPDGSSLAEKLAPDQEGLLYADIDLGAIGVAKNAADPAGHYSRPDVTRLLLNNKPYKRVEHFALPGDTVAPADVDAAAS

SEQ ID NO: 199 - DNA, 993 bp, Unknown
  Obtained from an environmental sample
atgtcaaacgcactgaagccgttcaaaatcgccgccgttcaggcgacgccggtttttctgaaccgggaagccacggcggagaaggccgcggctttgatccgcgaagcgggaagcgccggagccaagctcatcgttttcccggaatcgtttattccggcctatccggactgggtctgggtggtcccctcggggagggatcgccttctcagcggcctctacggggagatgctcgaaaacgccgtggaaatccccggcccggccacggggcatatcggccgggcggcgaaggaatcgggcgcttatgtcgtcatgggcgtgaccgagcgggacacggaggcgagcggagccagtttgttcaacaccttgatttatttcggtccgaccggggaaattttgggcaaacaccggaagctggttcccaccgggggcgaacggatcgtctgggcccagggggacggaagcaccctggaggtctacgatacgcccctgggaaaactgggcgggctgatctgctgggaaaactacatgcccctggcccggtacgccatgtacgcctggggaacccagctttacgtggccgccacctgggaccgaggcgaaccctggctttcgacgcttcggcatatcgccaaggaagggcgggtgtatgtcatcgggtgctgcatcgccatgcggaaaggggatatcccggatcggttcgaacacaaggggctctacgcccccgaccgggactggatcaaccccggcgacagcgcgatcgtcaacccccagggggagatgatcgccgggcccgcttccaataaggaagagatcctttatgcggaagtcgacccgcagatgatgcgcgggcccaaatggatgctcgatgtggccggccattacgcgcggcccgatgtcttcgagctcaccgtccgccgggaaccgcggccgatgatccgcgtggcgggaggcgcgggcgggaccgaacccaaagagaagaagaccgccggctga

SEQ ID NO: 200 - protein, 330 aa, Unknown
  Obtained from an environmental sample
MSNALKPFKIAAVQATPVFLNREATAEKAAALIREAGSAGAKLIVFPESFIPAYPDWVWVVPSGRDRLLSGLYGEMLENAVEIPGPATGHIGRAAKESGAYVVMGVTERDTEASGASLFNTLIYFGPTGEILGKHRKLVPTGGERIVWAQGDGSTLEVYDTPLGKLGGLICWENYMPLARYAMYAWGTQLYVAATWDRGEPWLSTLRHIAKEGRVYVIGCCIAMRKGDIPDRFEHKGLYAPDRDWINPGDSAIVNPQGEMIAGPASNKEEILYAEVDPQMMRGPKWMLDVAGHYARPDVFELTVRREPRPMIRVAGGAGGTEPKEKKTAG

SEQ ID NO: 201 - DNA, 930 bp, Unknown
  Obtained from an environmental sample
atgaccacgaagagcatccgcatcgcggccgtacaggcggctcccgcgtttctcgacctggctggtacgctggaccggctcgaggcctgggcccgcaaggccgccgccaccggtgcccgcgtcatcgcgttccccgagacctggctgccgggctacccggcgtggatcgactcgtcgccggaggccgcgatctggggccatcccggctcgcgcgacctgcaccagcgcctgatggagaatgccgtcgaggtcccgggccccgcgaccgcgcgcatcgcgaagctcgccggcgagctcggcgtgacgatcgtggtcggcgcgcacgagcgggcggggaacaccctctacaacacggcgctgacgttcgggcccgagggcaggctgctcaatcaccaccggaagctggtgccgacctacagcgaacggctgctgtggggctacggcgacggcgctggactggtggcgccggcggtggacggtgtgaaggtcggggcgctggtgtgctgggagcactggatgccgctcacccgccaggcgatgcacgacgtcggcgagcacgtgcacgtcgccctgtggcccggcgtccacgagatgcaccaggtggcctcgcggcactatgcgttcgagggccgctgtttcgtgatcgcggtcgggagcatcctgcgcgtggaccagatgccgaagcagctgccgccgctggagaagtacgcgaagagcgccaaggggctgatgatcgcgggcggcagcgccatcatcgcgccgaacggccgctacgtcgcggcgccggtgtacgacgaggagacgatcgtcaccgccgactgcgacctcggcgagatcccgcgcgaggcgcagacgctcgatgtctcgggccactacagccggccggacgtgttcagcttcggggtggtcagacaccggccgcgtgcgtaa

SEQ ID NO: 202 - protein, 309 aa, Unknown
  Obtained from an environmental sample
MTTKSIRIAAVQAAPAFLDLAGTLDRLEAWARKAAATGARVIAFPETWLPGYPAWIDSSPEAAIWGHPGSRDLHQRLMENAVEVPGPATARIAKLAGELGVTIVVGAHERAGNTLYNTALTFGPEGRLLNHHRKLVPTYSERLLWGYGDGAGLVAPAVDGVKVGALVCWEHWMPLTRQAMHDVGEHVHVALWPGVHEMHQVASRHYAFEGRCFVIAVGSILRVDQMPKQLPPLEKYAKSAKGLMIAGGSAIIAPNGRYVAAPVYDEETIVTADCDLGEIPREAQTLDVSGHYSRPDVFSFGVVRHRPRA

SEQ ID NO: 203 - DNA, 966 bp, Unknown
  Obtained from an environmental sample
atgtcaagcttacccacatccgcgttcaccgtcgccgccgcgcaagcgtcgccagtgttcctcgaccgcgacgcgacgctgcagaaggcttgcgggctgatcgccgacgccgggcgcgcgggcgcgcgcctgatcgtcttccccgaagccttcatcccggcctaccccgattgggtgtgggcggtcccagctggcgaagaggggatgctgagcgagctctacgccgagctggtcgcgaattcgctggctattccgagcgacgcgaccgatcggctatgtcgcgcggcgcaggccgcgcatatcaatgtggtcgtggggttgagcgagcgcaatgtcgaggccagcggcgccagcctctacaacacgctgctgtatatcgacgcggcgggaacgatcctgggtaaacaccgcaagcttgtgccgaccggcggggagcgcctggtctgggcgcagggcgacggcagcacgctcgatgtgtacgacaccgcgctcggcaagctcggcggcctgatctgttgggaaaactacatgccgctggcacgctacgcgctgtacgcctggggtgtgcaaatctatgtcgcggccacctgggatcgcggcgagccctggctttctactctgcgacatatcgccaaggaaggccgtgtctacgtgatcggctgtggcatggcgctgcgcagagatgatattcccgatcgcttcgctttcaagcagcgcttctatgcccaggccggcgaatggatcaacgtcggcgacagcgcgatcgtcaacccgagcggcgagtttattgccggacctgtgcgcgaacgcgaggagattctgtacgcggaggtcgacccggagcagatgagcgggccaaagtggatgctcgacgtggccgggcactacgggcggccggatgtcttccggctcagcgtcaaccgggcgccgcaccagatgatccagacggagaaccgggagacctga

SEQ ID NO: 204 - protein, 321 aa, Unknown
  Obtained from an environmental sample
MSSLPTSAFTVAAAQASPVFLDRDATLQKACGLIADAGRAGARLIVFPEAFIPAYPDWVWAVPAGEEGMLSELYAELVANSLAIPSDATDRLCRAAQAAHINVVVGLSERNVEASGASLYNTLLYIDAAGTILGKHRKLVPTGGERLVWAQGDGSTLDVYDTALGKLGGLICWENYMPLARYALYAWGVQIYVAATWDRGEPWLSTLRHIAKEGRVYVIGCGMALRRDDIPDRFAFKQRFYAQAGEWINVGDSAIVNPSGEFIAGPVREREEILYAEVDPEQMSGPKWMLDVAGHYGRPDVFRLSVNRAPHQMIQTENRET

SEQ ID NO: 205 - DNA, 969 bp, Unknown
  Obtained from an environmental sample
atgaccaccgtaaaagccgccgcagtacagatcagccccgtgctctatagccgggaggccaccgtagacaaggtcgttcgcaagatccgcgagctcggccaaaagggagtgcagttcgccaccttcccggaaaccgtagtgccgtactacccctacttcgctgcagtccagacaggcatcgaactgttgtccggcaaggaacacatgcgcctgctggagcaggccgttaccgtcccctcgcccgccacggatgcgattgctcaggcggcgcgcgaagccaatatggtggtgtccatcggcgtcaacgagcgcgacggcggcaccatctacaacacgcagctgctcttcgatgccgacggcacgctcgtgcagcgccgccgcaagataacgccaacgcacttcgagcgcatggtctggggccagggcgatggttcgggattgcgcgccgcggacaccaaggttggccgcatcggccagttggcctgcttcgagcacaacaacccgctcgcccgttacgccatgatggccgatggcgagcagatccactccgccatgtacccgggctcggccttcggcgagggcttcgcgcagcgcatggagatcaacatccgccagcatgccctggagtctggctgcttcgtggtgaatgcgaccgcctggctcgatgccgaccaacaggcgcagatcatgaaggacaccggttgctcgatcggcccgatctccggcggctgcttcacgaccatcgtcacgcctgagggcatgctgattggcgagccgctccgcgagggcgaaggcgaaatcatcgccgacctcgatttctcgatgatcgatcgccgcaagctgctgatggactcggtcggtcactacaaccgtccggagcttctgagcctcctgatcgatcgcacgcctgccgcgaacttccatgaacgtaccgcgagccaggcgaacgccggcgtcgaaatcctctga

SEQ ID NO: 206 - protein, 322 aa, Unknown
  Obtained from an environmental sample
MTTVKAAAVQISPVLYSREATVDKVVRKIRELGQKGVQFATFPETVVPYYPYFAAVQTGIELLSGKEHMRLLEQAVTVPSPATDAIAQAAREANMVVSIGVNERDGGTIYNTQLLFDADGTLVQRRRKITPTHFERMVWGQGDGSGLRAADTKVGRIGQLACFEHNNPLARYAMMADGEQIHSAMYPGSAFGEGFAQRMEINIRQHALESGCFVVNATAWLDADQQAQIMKDTGCSIGPISGGCFTTIVTPEGMLIGEPLREGEGEIIADLDFSMIDRRKLLMDSVGHYNRPELLSLLIDRTPAANFHERTASQANAGVEIL

SEQ ID NO: 207 - DNA, 966 bp, Unknown
  Obtained from an environmental sample
atgtcaaacgagaacaacaacgctacattcaaagttgccgcagtacaggctacacctgtttttctcgatcgtgaagcgactctcgacaaggcttgcgatttgatcgccgccgccggaggtgaaggggcacgattggttgtctttccagaagccttcataccggcctatccggattgggtatgggcaatcccaccgggtgaagagggcgtacttaatgagttgtacgcagagctgctctccaactcggtcacgattcccagtgacgcgacggacagactgtgccgggccgcgaggcttgctaatgcttacgtggtgatggggataagcgaacgcaatgtcgaggcgagtggagcaagcctgtataacacgctgttgtacatcgatgcgcagggtgagattctaggcaaacatcgaaagctagtgccaacgggcggcgagcggctggtgtgggcgcagggcgatggcagcacactgcaggtctacgatactccactgggaaaactcggcggtttaatttgctgggagaattatatgccgctggcccgctataccatgtatgcctggggcacacaaatctatgtcgccgctacgtgggatcgcgggcaaccctggctctccactttgcggcatatcgccaaagaaggcagggtgtacgtgattggttgttgtatcgcgatgcgcaaagacgatatccctgatcgttacgcaatgaagcagaagttttacgcggaggcagatgagtggatcaatataggtgacagcgcgattgtcaatcctgaagggcaatttatcgcagggccagtacgcaagcaggaagagattctctacgcagagattgatccgcgcatggtacaagggccgaagtggatgctcgacgtggcggggcactatgccaggccggatgtgttccagttgacggtgcatacggatgtgcgacagatgattcggatggaacacgattcttaa

SEQ ID NO: 208 - protein, 321 aa, Unknown
  Obtained from an environmental sample
MSNENNNATFKVAAVQATPVFLDREATLDKACDLIAAAGGEGARLVVFPEAFIPAYPDWVWAIPPGEEGVLNELYAELLSNSVTIPSDATDRLCRAARLANAYVVMGISERNVEASGASLYNTLLYIDAQGEILGKHRKLVPTGGERLVWAQGDGSTLQVYDTPLGKLGGLICWENYMPLARYTMYAWGTQIYVAATWDRGQPWLSTLRHIAKEGRVYVIGCCIAMRKDDIPDRYAMKQKFYAEADEWINIGDSAIVNPEGQFIAGPVRKQEEILYAEIDPRMVQGPKWMLDVAGHYARPDVFQLTVHTDVRQMIRMEHDS

SEQ ID NO: 209 - DNA, 993 bp, Unknown
  Obtained from an environmental sample
atgaaagtcgtcaaagccgccgctgtccagatcagtcccgttctctacagccgtgaggcaaccgtcgaaaaggtcgtgaagaaaattcacgagcttggccaactgggcgtgcagttcgccacctttcccgagaccgtagtgccttactacccgtacttttccgccgtccagacaggcattgagcttctgtccggaactgagcatctgcggctgctcgatcaggccgtgacggtaccgtctcccgctaccgatgcgatcggagaggcggcccgcaaggcgggcatggtggtgtccatcggcgtgaatgaacgcgacggcggcaccttgtacaacacacagttgctcttcgatgccgatggcaccttgatccagcgccgccgcaagatcacgcccacccacttcgaacggatgatctggggccagggggacggctcgggcctgcgcgccgtcgacagcaaggttggtcgcattggtcagcttgcctgcttcgagcacaacaacccgctggcccgctacgcgctgattgccgacggcgagcagatccattccgccatgtatccgggttctgctttcggcgaaggctttgcccaaaggatggaaatcaatatccgccagcatgcgctggagtctggtgcctttgtcgtcaacgcaacggcctggctggatgctgaccagcaggcgcaaatcatcaaggacaccggctgtgggattggcccgatctcgggcggctgcttcaccacgatcgtggcacccgacggcatgctgatggccgaacctctgcgttcgggcgagggtgaggtcatcgtggatctcgacttcacgctgatcgaccgacgcaagatgttgatggactcggcgggccactataaccgtccagaactgctcagtctcatgattgaccgtaccgcgacggcgcatgttcacgaacgcgctgcgcatccggtgtcgggcgcggagcagggtccggaggatctgcgcactccggccgcgtga

SEQ ID NO: 210 - protein, 330 aa, Unknown
  Obtained from an environmental sample
MKVVKAAAVQISPVLYSREATVEKVVKKIHELGQLGVQFATFPETVVPYYPYFSAVQTGIELLSGTEHLRLLDQAVTVPSPATDAIGEAARKAGMVVSIGVNERDGGTLYNTQLLFDADGTLIQRRRKITPTHFERMIWGQGDGSGLRAVDSKVGRIGQLACFEHNNPLARYALIADGEQIHSAMYPGSAFGEGFAQRMEINIRQHALESGAFVVNATAWLDADQQAQIIKDTGCGIGPISGGCFTTIVAPDGMLMAEPLRSGEGEVIVDLDFTLIDRRKMLMDSAGHYNRPELLSLMIDRTATAHVHERAAHPVSGAEQGPEDLRTPAA

SEQ ID NO: 211 - DNA, 1062 bp, Unknown
  Obtained from an environmental sample
atgggcgtcgcacatccgaaatacaaagtggccgccgtgcaggcagcgcccgcttttctcgacctggacgcctcggtcgaaaaggccgtccgtttcatcgacgaagccggcgccgccggcgcccgcctcatcgcctttccggagacctggatacccggttacccctggtggatctggctaggcgcgccggcctgggctatcatgcgcggcttcgtctcgcgctatttcgacaactcgctcagctacgacagcccgcaggccgagaagctccgcgccgccgccaagcgcaacaagatggtggtggtgctcggcctctccgagcgcgacggcggcagcctttacatcgcgcaatggatcatcggcccggacggcgaaaccatcgccaagcgccgcaagctcaagccgacccacgcggagcggaccgtgttcggcgaaggcgacggctcgcatcttgcggtgcacgagcttgatgttggccggctcggcgcgctgtgctgctgggaacacctgcagccgctgtccaaatacgccatgtatgcgcagaacgaacaggtgcatgtcgcggcctggccgagcttttcgctttacgatccgttcgcgcacgcgctcggcgcggaagtgaacaatgcggcgagcaaaatctatgcggtcgagggctcgtgtttcgtcatcgcgccgtgcgcgaccgtttcgcaggcgatgatcgacgaactctgcgatacgccggagaagcatcagttcctgcatgccggcggcggctttgccgtgatttacggccccgacggcgccccgctcgcggcgccgctgccgcccgacaaggaaggcttgctctacgccgacatcgatctcgggatgatttcggttgccaaagcggcagccgatccggccgggcattatgcacgccccgacgtcacccggcttctgttcaacaatcggcctgggtatcgggtcgagaccatggcgttgccgatcgatgcggagaccaaggcggaagcaccggctaagccggaacccaaggcaccgaacgtggcgccgttcgcgccggtgcaagcggccgagtga

SEQ ID NO: 212 - protein, 353 aa, Unknown
  Obtained from an environmental sample
MGVAHPKYKVAAVQAAPAFLDLDASVEKAVRFIDEAGAAGARLIAFPETWIPGYPWWIWLGAPAWAIMRGFVSRYFDNSLSYDSPQAEKLRAAAKRNKMVVVLGLSERDGGSLYIAQWIIGPDGETIAKRRKLKPTHAERTVFGEGDGSHLAVHELDVGRLGALCCWEHLQPLSKYAMYAQNEQVHVAAWPSFSLYDPFAHALGAEVNNAASKIYAVEGSCFVIAPCATVSQAMIDELCDTPEKHQFLHAGGGFAVIYGPDGAPLAAPLPPDKEGLLYADIDLGMISVAKAAADPAGHYARPDVTRLLFNNRPGYRVETMALPIDAETKAEAPAKPEPKAPNVAPFAPVQAAE

SEQ ID NO: 213 - DNA, 993 bp, Unknown
  Obtained from an environmental sample
atgagagttgttaaagccgctgctgtccaactgagtcccgtcctctatagtcgcgagggaacggtcgaaaaggtcgtgcggaagatccatgaacttgccgaagagggagtcgagttcgccacctttcctgagaccgtggtgccttactacccgtacttttccttcgttcagacgcccttggagcaaatcttcggaacagagtatctgaggctgctcgaccaggcagtcaccgtgccatcccctgccaccgacgcgatcggcgaggcagccaggttcgctggagttgttgtctcgatcggcgtcaacgagcgagacgggggaactctatacaacactcagcttctcttcgatgccgacggcaggataattcagcggcgccgcaagatcacgcccacccattacgagcgcatgatctggggccagggcgacggctcaggtctgcgggccgttgatagcaaggccggccgtattggtcagctggcatgctgggagcacaacaatccactggcgcgctacgcgctgatggccgacggcgagcagatccattccgccatgtatccgggctccatgttcggcgactcgtttgcccagaagaccgaaatcaatatccggcagcatgccctagagtctgggtgcttcgtcgtgaacgcaacggcctggctggacggcgatcagcaggcgcatatcatgaaggacaccggctgcagcatcggcccgatctccggcggttgcttcactgcgatcgtcgcacccgatggtagcctgctgggcgaacccatccgttccggtgagggcgtggtcatcgccgacctcgacttcacgttgatcgacaggcgtaagcaggtgatggactcgcgaggccattacagccggccggagttgctcagcctcttaatagaccgcacccctaccgcgcactttcacgaacgcgcttcgccccccacgacagaagctgagcaaggctccgaggatgtgttcgaggctcgcatttaa

SEQ ID NO: 214 - protein, 330 aa, Unknown
  Obtained from an environmental sample
MRVVKAAAVQLSPVLYSREGTVEKVVRKIHELAEEGVEFATFPETVVPYYPYFSFVQTPLEQIFGTEYLRLLDQAVTVPSPATDAIGEAARFAGVVVSIGVNERDGGTLYNTQLLFDADGRIIQRRRKITPTHYERMIWGQGDGSGLRAVDSKAGRIGQLACWEHNNPLARYALMADGEQIHSAMYPGSMFGDSFAQKTEINIRQHALESGCFVVNATAWLDGDQQAHIMKDTGCSIGPISGGCFTAIVAPDGSLLGEPIRSGEGVVIADLDFTLIDRRKQVMDSRGHYSRPELLSLLIDRTPTAHFHERASPPTTEAEQGSEDVFEARI

SEQ ID NO: 215 - DNA, 1008 bp, Unknown
  Obtained from an environmental sample
atgagtattacccaccccaaatttaaagctgctgttgttcaagctgccccagtatttctagacctagatgggtctgttaataaggcgattaatctcattgatgaagctgccgctgccggagccaagctcattgccttccctgaaaccttcattccaggctatccatggtggatttggctgggatcgccggcgtgggctctgggccgggggttcgttcagcgttacttcgacaattccctgcagtacgacagcccgcaggcggatcgcttacgcgaggcggcacgacgcaacagcattacggtcgtgctgggcttgtccgagcgtgatggcggttctctctatatcgcacagtggctgatcggcccggatggcgaaaccatcgcgcagcggcgcaagcttcgtcctactcatggggagcgcacggtattcggtgaaggggatggcagcgatctggtggttcatcaaaccgaactgggccgtcttggcgcgcttaactgctgggagaacatcctgtctctgaacaaatatgtgatgtactcccagcatgaacaggtccatgtagcatcctggcccagtttctcgacgtatgaaccgttcgcgcatgcgctcggctatgaggtaaacaacgcaattagccaggtctatgcggtggaaggcgggtgcttcgtgttggccccgtgctctaccatctctgaagaaatgattgccgaactgtgcgatacacccgataaattcgagctgacgcatgctggtggcggccacgcaatcatctatggtccggacggtcgtgctctgtgcgaaaagctgcccgagaaccaggagggcctgctgtacgcggaaatcgatctgggggtgatttctatggcaaaaagtgccatggatcctgtcggccattactctcgccccgatgtctaccgtgtgctgttcaataagatcccggcaaagcgtatcgagcacttcaatttgccgttggatgagcaagcaggggaagagccaccagctgattaa

SEQ ID NO: 216 - protein, 335 aa, Unknown
  Obtained from an environmental sample
MSITHPKFKAAVVQAAPVFLDLDGSVNKAINLIDEAAAAGAKLIAFPETFIPGYPWWIWLGSPAWALGRGFVQRYFDNSLQYDSPQADRLREAARRNSITVVLGLSERDGGSLYIAQWLIGPDGETIAQRRKLRPTHGERTVFGEGDGSDLVVHQTELGRLGALNCWENILSLNKYVMYSQHEQVHVASWPSFSTYEPFAHALGYEVNNAISQVYAVEGGCFVLAPCSTISEEMIAELCDTPDKFELTHAGGGHAIIYGPDGRALCEKLPENQEGLLYAEIDLGVISMAKSAMDPVGHYSRPDVYRVLFNKIPAKRIEHFNLPLDEQAGEEPPAD

SEQ ID NO: 217 - DNA, 1011 bp, Unknown
  Obtained from an environmental sample
gtgggtatcagccatccgaaattcaaggctgcggtcgtacaggccgggcctgccttcctcgacctcgacggcggcgtcgaacgagccgtgtcgctcatcggccaagcagcggccgaaggggcacagctgattgcctttcctgaaacgtggattcccggttacccgtggcacacctggcttggcagcccggcgtgggcaatggaaaaaggctttgtccaacgatatttcgacaacgcgttgcggcatggttctccgcaagccgagcgaatctccggggctgcggcggagcacaagattatggtgtcgcttgggtttgcggaacgcgatggaggcacgctttatatcgcgcagtggctcatcggacccgacggccaaactatctcacgacggcggaagcttaagccgactcacgtcgagcgcactgtatttggcgagggagacggaagcgatctctccgtgcatgatacggcgcttggacgtatcggctcactttgttgctgggagcatttgcaaccgttgtcgaaatacgcaatgtacgcccagaatgaacagattcacattggcgcatggcccagcttttcgctataccagccatttgcgaatgcgctgagtcccgaagtcaatatcgcagtaagccgcgtgtacgccgtggaaggccagtgtttcttcctcgcgccgtgcgcgacggtttcggacgccatgatcgaaacactgtgcgatacgcccgaaaagcagggactgattcgggcgggtggcgggcacgccgcgatcttcggcccagatggaagtctgctgacgcctacggtagcggatacttacgagggcctgctgtatgcagaactcgacctcggcgtcatttcgatcgccaagagtgcagcggaccccgccggccactattcgcggccagatgtcacacgccttctattgaatcagacgccttcgaagcgcgttcagaatatggtgttaccactggagacggtcacggagcccgaaggcccggttcagccctag

SEQ ID NO: 218 - protein, 336 aa, Unknown
  Obtained from an environmental sample
VGISHPKFKAAVVQAGPAFLDLDGGVERAVSLIGQAAAEGAQLIAFPETWIPGYPWHTWLGSPAWAMEKGFVQRYFDNALRHGSPQAERISGAAAEHKIMVSLGFAERDGGTLYIAQWLIGPDGQTISRRRKLKPTHVERTVFGEGDGSDLSVHDTALGRIGSLCCWEHLQPLSKYAMYAQNEQIHIGAWPSFSLYQPFANALSPEVNIAVSRVYAVEGQCFFLAPCATVSDAMIETLCDTPEKQGLIRAGGGHAAIFGPDGSLLTPTVADTYEGLLYAELDLGVISIAKSAADPAGHYSRPDVTRLLLNQTPSKRVQNMVLPLETVTEPEGPVQP

SEQ ID NO: 219 - DNA, 996 bp, Unknown
  Obtained from an environmental sample
atgaaaatcgtcaaagctgccgccgttcaaattagtcccgtgctttatagccgcgatggaacggtggaaaaagttgtgcggaagatccatgagctcggccaacagggagtgcagttcgcaaccttccccgagaccgtgattccgtactatccctatttttcctttctgcaacccgcctaccagatcgcggccgggcaggagcacctcaagttgctcgaccaggcggtgacggtgccgtccgctgccacgcacgcgatcggccaggcatgcaaacaggcaggagtggttgtttcgatcggcatcaatgagcgggacaatggaacgatctacaacacccagcttctcttcgactccgacggaaccctgctgcagcggcgccgcaagatctcacccacttaccacgaacggatgatctggggccagggcgacggttccggcctgcgcgccgtggatagcaaggccggccggattgggcagctcgcctgttgggagcactacaaccctttggcgcgctacgcgatgatggccgacggcgagcagatccattccgccatgtaccctggctccatcttcggcgatctgtttgccgaacagacccagatcaacgtccggcagcacgcgttggagtccggctgtttcgtagtctgctccaccgcctggttggatcccgatcaacaagcgcaaatcgtcaaggacacaggcggcgccattggtgcgatctcgggcggctgtttcacggcgattgtggcccccgatagcactctgctcggagagccgatccgctccggcgaaggcgtggtcattgcggatctcgacttcacccggatcgacaagcgtaaacagttgatggattcccgaggtcattacagccggccggaattgctgagtctgctgattgatcgcacttccaccgcacatgtgcaaaaccgcgtgccggccgatccattcggcgccggctgtgttgcagaaccaggagtagaaacatgcccacgatag

SEQ ID NO: 220 - protein, 331 aa, Unknown
  Obtained from an environmental sample
MKIVKAAAVQISPVLYSRDGTVEKVVRKIHELGQQGVQFATFPETVIPYYPYFSFLQPAYQIAAGQEHLKLLDQAVTVPSAATHAIGQACKQAGVVVSIGINERDNGTIYNTQLLFDSDGTLLQRRRKISPTYHERMIWGQGDGSGLRAVDSKAGRIGQLACWEHYNPLARYAMMADGEQIHSAMYPGSIFGDLFAEQTQINVRQHALESGCFVVCSTAWLDPDQQAQIVKDTGGAIGAISGGCFTAIVAPDSTLLGEPIRSGEGVVIADLDFTRIDKRKQLMDSRGHYSRPELLSLLIDRTSTAHVQNRVPADPFGAGCVAEPGVETCPR

SEQ ID NO: 221 - DNA, 1146 bp, Unknown
  Obtained from an environmental sample
atgttgacctacaaaggcgtgttcaaagcagcgacagttcaggcggagccggtgtggatggacgctgacgccaccattaccaaagccatccggatcatcgaagaggcggctgataacggggcgaagtttgtcgcattcccggaggtgttcatccctggatacccttggtggatctggctgggcactgcgatgtggggagccaaattcgtcgtgcccttccacgaaaattgccttgagcttggcgacaagcggatgcagcgcattcaagctgcggcaaaacaaaatggcattgcactcgtcatgggttacggtgaacgtgacggaggtagccgctacatgagccaggtattcatcgacgatagcggaaaaattgtggcgaaccgccgcaagctcaaaccgacgcacgaagagcgaacgattttcggcgagggaaacggatccgatttcatcacccatgacttcccatttgcgagagtcggaggcttcaactgctgggaacaccttcagcccctgagcaaatacatgatgtacagcctgcaggaacaggtgcatgtcgcgtcgtggccggccatgtgcacctatcagcctgacgtgccccagttaggtgcaggcgctaacgaggcggtcacccgctcttacgcgatcgaaggcgcatgttatgtgctgggagcgacactcgttatcggcaaggcagcccatgatgcattctgcgacactgaagagcatcacaagctgcttggcatgggcggagggtgggcccgaattttcggcccggacggtgagtatctcgcagaatcgctcgctcatgacgcggagggcatcctgtacgctgacattgatctgagcaagatcctgctcgccaaagcaaacacggacacagttggccactacgcgcgacctgacgtcttgtcattgctcgtcaacacacacaatcccgggcctgtacgctatcttgacgaagagggccggcaggtttcaacgtcaattcgcaggcacgaaaaactggaaggccagagcctcgacctcgaggttacgccagcgacaccagcgaccctggacatcgcgagcctggtacaacaggctaagccatcgaccgttaagagcgagagtaacgcgagcacaaaacaaccggatctcgcggtctga

SEQ ID NO: 222 - protein, 381 aa, Unknown
  Obtained from an environmental sample
MLTYKGVFKAATVQAEPVWMDADATITKAIRIIEEAADNGAKFVAFPEVFIPGYPWWIWLGTAMWGAKFVVPFHENCLELGDKRMQRIQAAAKQNGIALVMGYGERDGGSRYMSQVFIDDSGKIVANRRKLKPTHEERTIFGEGNGSDFITHDFPFARVGGFNCWEHLQPLSKYMMYSLQEQVHVASWPAMCTYQPDVPQLGAGANEAVTRSYAIEGACYVLGATLVIGKAAHDAFCDTEEHHKLLGMGGGWARIFGPDGEYLAESLAHDAEGILYADIDLSKILLAKANTDTVGHYARPDVLSLLVNTHNPGPVRYLDEEGRQVSTSIRRHEKLEGQSLDLEVTPATPATLDIASLVQQAKPSTVKSESNASTKQPDLAV

SEQ ID NO: 223 - DNA, 996 bp, Unknown
  Obtained from an environmental sample
atgagagttgttaaagccagcgcagttcaactgaagcctgtactttatagccgcgaggggacggtcgaaaaggtcgtagcgaagattcatgagctagggcagcagggtgtgcagttcgccgcgttccctgagaccgtggtgccttattacccgtacttttcgatcgtgcagtccggctatcaaatccttcgcggcggtgagttcgtcaagctcctcgatcagtccgtgacggtgccatcttatagcactgaagccatcggcgaagcctgcaggcaggaggagatggttgtctccataggcgtcaacgagcgtgatggcggaacgatctacaacgcgcagttactctttgattccgacggcacgttgatccaaagacgacgcaagatcacccccacccattacgaacgcatgatctggggccagggcgatggctcaggtctgcgcgctgttgacagcaatgtcgcacgcattggtcaactggcatgctttgagcactacaaccctcttgcgcggtacgcgatgatggccgatggcgagcagatccattccgccatgttccccggttccatgttcggcgatggttttgcggagaggacggaaattgccgtaaggcaacatgcgatggagtccgggtgctttgtcgtttgcgctacggcctggctcgatcccggccagcaggctcagatcgccaacgacaccggtatcaccgacatcggcccgatctccgggggttgcttcactgcgatcatcgcacccgatgggagcctgctgggccaacctatccgctcgggtgaaggcgaagtcatcgtcgacctcgatttcacgttaattgacaagcggaaacatattgtcgactcgagaggacattacagccggccagaattgctgagcctgctgatcgatcgcactcccaccgcgcaccttcacgaccgcgctgtgcagcacaatgccggatcggaaggagcgtcggaacatcttcgcgaagacgccgcctga

SEQ ID NO: 224 - protein, 331 aa, Unknown
  Obtained from an environmental sample
MRVVKASAVQLKPVLYSREGTVEKVVAKIHELGQQGVQFAAFPETVVPYYPYFSIVQSGYQILRGGEFVKLLDQSVTVPSYSTEAIGEACRQEEMVVSIGVNERDGGTIYNAQLLFDSDGTLIQRRRKITPTHYERMIWGQGDGSGLRAVDSNVARIGQLACFEHYNPLARYAMMADGEQIHSAMFPGSMFGDGFAERTEIAVRQHAMESGCFVVCATAWLDPGQQAQIANDTGITDIGPISGGCFTAIIAPDGSLLGQPIRSGEGEVIVDLDFTLIDKRKHIVDSRGHYSRPELLSLLIDRTPTAHLHDRAVQHNAGSEGASEHLREDAA

SEQ ID NO: 225 - DNA, 951 bp, Unknown
  Obtained from an environmental sample
atgaccaccgtcaaagccgccgctgtccagatgagtcccgtgctttacagtcgcgacgataccatcgagaaaatttgtcgacagatcatcgagcttggccgacagggagtgcagttcgccacgtttccagagacagttattccgtattatccatatttcgccttcgtgcagcggccttacgaaatgtcggcccaatatcatcagttgcttgatcaagcggtgaccgtgccttccggttcaacgcacgccattggggccgcctgtaaacaagccggaattgttgtctcaatcggcgtcaacgagcgggagggcggcacgctctatggcacacagttgctgtttgatgcagacggcctcttgatccagcgtcgccgcaagatcactccgacctaccacgagcggatgatttggggacagggtgacggttccgggctgcgagccgtagatagcgcggtcggtcgaatcggacagttggcgtgttgggaacaccacaatccgctggctcgttatgctttagcggccgatggcgaacaaattcacgcggcgatgtaccctggctcgatcttgggtgaactatttgccgagcagattcaggtcaacatccggcagcacgccatggaatctggttgcttcgtcgtgaacgccacggcctggctaagcgaggaacagcaagcccgaatcatgaaggacaccggatcattcgatagcccaatcaccggtggttgctttaccgccattgtcgcgcccaacgggcagataatcggtgaaccgctgcgcatcggcgaaggcgtcgtgattgccgatttggacttcgctttgattgatgagaggaagcggctgatggactcacgcggcctctatagccgccctgagttgctaagcttgttaatcgacagaatgcctacatcccatgtgcatgaacgggttgagcgtagcatggcgatggcatga

SEQ ID NO: 226 - protein, 316 aa, Unknown
  Obtained from an environmental sample
MTTVKAAAVQMSPVLYSRDDTIEKICRQIIELGRQGVQFATFPETVIPYYPYFAFVQRPYEMSAQYHQLLDQAVTVPSGSTHAIGAACKQAGIVVSIGVNEREGGTLYGTQLLFDADGLLIQRRRKITPTYHERMIWGQGDGSGLRAVDSAVGRIGQLACWEHHNPLARYALAADGEQIHAAMYPGSILGELFAEQIQVNIRQHAMESGCFVVNATAWLSEEQQARIMKDTGSFDSPITGGCFTAIVAPNGQIIGEPLRIGEGVVIADLDFALIDERKRLMDSRGLYSRPELLSLLIDRMPTSHVHERVERSMAMA

SEQ ID NO: 227 - DNA, 1035 bp, Unknown
  Obtained from an environmental sample
atgtccgatcgacgcatcgttcgcgcggcagccattcagatcgccccggatctcgagcgctgcagtgtaacgctcgagaaggtttgctcggcgatcgacgaagccgcgggcaaaggcgctcaactgagcgtctttcccgagaccttcgtcccgtactacccctatttctcgtttgtccgccctccggtcgcatcgggggccgatcacatgcggctatacgaggaagcggtggtggtgccgggtcccgtgacgcaggctgtttccgaacgtgcgcgcatgcatgggatggtggtggtgctcggcgtcaacgagcgcgaccacgggagcctctacaacacccaactgattttcgattgcgatggtcggctcgctctgaaacgccgcaagatcacgccgacgtttcacgagcgcatgatctggggccagggcgacgccagtggactgaaagtcgcgcgcacgggtatcgggcgggtcggcgcgctcgcgtgctgggagcattacaacccgctcgcgcgctacgcgctgatgacccagcacgaagagatccattgcagtcaatttccaggctcgctcgtcggtccgatcttctccgagcagatggacgtgacgatccgccatcacgccctcgaatcggggtgcttcgtcgtgaacgcaaccggttggctcacggacgcgcagatcgcctcgatcaccgatgacccgaagcttcaacgggcgctgcgcggtggctgcaacacggcgatcgtttcaccggaaggccagcatctggcggagccgttgcgcgaaggcgaggggatggtggtcgcggacctcgacatgtcgctcatcaccaagcgcaagcgaatgatggattcggtcggccactatgcgcggccggaactgttgagcctcgcgatcaacgatcgtcccgcagcccctttcggccggatgtgcgctgccgaagcaatgcggggagccgacgacgtcgtcacagtaggagcatttcatgagcgccagcgagaacgtgtcggcgaagagccggcaattgatgactga

SEQ ID NO: 228 - protein, 344 aa, Unknown
  Obtained from an environmental sample
MSDRRIVRAAAIQIAPDLERCSVTLEKVCSAIDEAAGKGAQLSVFPETFVPYYPYFSFVRPPVASGADHMRLYEEAVVVPGPVTQAVSERARMHGMVVVLGVNERDHGSLYNTQLIFDCDGRLALKRRKITPTFHERMIWGQGDASGLKVARTGIGRVGALACWEHYNPLARYALMTQHEEIHCSQFPGSLVGPIFSEQMDVTIRHHALESGCFVVNATGWLTDAQIASITDDPKLQRALRGGCNTAIVSPEGQHLAEPLREGEGMVVADLDMSLITKRKRMMDSVGHYARPELLSLAINDRPAAPFGRMCAAEAMRGADDVVTVGAFHERQRERVGEEPAIDD

SEQ ID NO: 229 - DNA, 975 bp, Unknown
  Obtained from an environmental sample
atgcctgaaaacaaagtcaaagttgccctcgttcagcatccgcctgtttttctgaatttgccgaaaacgttggaaaaagtagaaggtttggcgcgagagtgcgccgccaatgaagcgaaaatcgttgtctttcctgaaacctggctgaccggctatccggtctggcttgatgaagcgccgagagccgcgctgtgggattatccgcccgccaagcgtttgtatcaatacctcacggaaaattcattgcagattccgagcgctgagtttgaatctttgcgcgaaatcgctaagaaaaattccctttatttagtcgttggagttcacgaacgaagcggcggaacgctctacaatacgataatttatctcacgcccgacggcagttataaaactcaccgcaaattggttccaacttacacggaaagacttgtctggggcgcaggcgacggaagcggtctaaatgttgtggaaacgccttacgggattctcggaggtttgatttgctgggaacattggatgcctctggctagggcggcaatgcattcaaaaaatgaagcgattcacgtttgccaatttcccacggttcacgagcgacatcaaatcgccagccgtcattacgccttcgaagggcagtgttttgtcttgacttccggttgcgcgatgacgaaaacggatgttttggaaggttttgaatcgctcgaaacaaacgaccacgaagttttcgggcttttggattcgatagaaaaggaagaactgatgcgtggcggaagcgcgattattgcgcccgatttgagctattcggtcgagccggtttttgacgaaaaaacgattgtttacggcgaattaaatctcgatttaaccaagcagggacatctgtttttggataccgacggacattattcgcgtcccgatgttttcgagttgcgcgtcaacgataaagcgaaccgaaacgtccgttttgcatccgaaacagtatag

SEQ ID NO: 230 - protein, 324 aa, Unknown
  Obtained from an environmental sample
MPENKVKVALVQHPPVFLNLPKTLEKVEGLARECAANEAKIVVFPETWLTGYPVWLDEAPRAALWDYPPAKRLYQYLTENSLQIPSAEFESLREIAKKNSLYLVVGVHERSGGTLYNTIIYLTPDGSYKTHRKLVPTYTERLVWGAGDGSGLNVVETPYGILGGLICWEHWMPLARAAMHSKNEAIHVCQFPTVHERHQIASRHYAFEGQCFVLTSGCAMTKTDVLEGFESLETNDHEVFGLLDSIEKEELMRGGSAIIAPDLSYSVEPVFDEKTIVYGELNLDLTKQGHLFLDTDGHYSRPDVFELRVNDKANRNVRFASETV

SEQ ID NO: 231 - DNA, 1062 bp, Unknown
  Obtained from an environmental sample
atgagtcagatccatccaaaacttaaggtcgcggccgtgcaggctgcccccgcctttctcgatctcgatgcatcgatcgaaaagacaatacgctatgtcgacgaagcggctgcggccggggcgaagttgattgcgtttccggaaacctggattcccggctacccatggtggatctggctcggcgctccggcctgggcgatcatgcgtggcttcgtctcgcgctatttcgacaactcgctgcaatatggcagtccggaagctgaacggctgcgggacgccgccaggcgcaacaagatatacatcgccctcggcctgtccgagcgcgacgggggcagtctttatatcgcgcaatggatcatcgggcctggcggcgaaacggttgcacaacgccgcaagctcaagcccacgcacgccgagcgcactgtattcggcgaaggcgatggttcacatctggccgtgcatgatctcgatattggaagattgggcgcgctttgttgctgggaacatctgcaaccgttgtcgaaatatgcaatgtacgcccagaacgagcaaattcacgtcgccgcctggccgagcttctcgctatacgatccctttgcacacgcactcggcgccgaggtcaataacgctgcgagcaagatctatgcggtcgagggatcgtgcttcgtcattgcgccgtgcgcaacggtttcgcaggtgatgatcgatgagctctgcgatacccccgaaaagcatcaattccttcacgtcggcggcggcttcgccgtcatttacggtcccgacggctcgccactggccaaacctcttccgccagaccaggagggacttctctatgccgacatcgatctcggcatgatctcggtcgccaaggccgcagccgatcccgccggacattatgcacgtcccgatgtaactcgcctgctgttcaacaatcgcccggcaaaccgcgtcgagaagctggcgttgccggtcgatcaggaggccgaagtggatagtccgctgaaggctcccgacgcatctcccaaagtgacggcgctcaagccgtcgcaggctgcggagtag

SEQ ID NO: 232 - protein, 353 aa, Unknown
  Obtained from an environmental sample
MSQIHPKLKVAAVQAAPAFLDLDASIEKTIRYVDEAAAAGAKLIAFPETWIPGYPWWIWLGAPAWAIMRGFVSRYFDNSLQYGSPEAERLRDAARRNKIYIALGLSERDGGSLYIAQWIIGPGGETVAQRRKLKPTHAERTVFGEGDGSHLAVHDLDIGRLGALCCWEHLQPLSKYAMYAQNEQIHVAAWPSFSLYDPFAHALGAEVNNAASKIYAVEGSCFVIAPCATVSQVMIDELCDTPEKHQFLHVGGGFAVIYGPDGSPLAKPLPPDQEGLLYADIDLGMISVAKAAADPAGHYARPDVTRLLFNNRPANRVEKLALPVDQEAEVDSPLKAPDASPKVTALKPSQAAE

SEQ ID NO: 233 - DNA, 1002 bp, Unknown
  Obtained from an environmental sample
gtgagcaccatcgtcaaagccgcggccgtgcagatcagccccgtgctgtacagccgcgagggcaccgtcgagcgggtcgtgaagaagatccgggagctgggcgaaaagggcgtccagttcgccaccttccccgagaccgtcatcccttactacccgtacttttccttcgttcagacgcccttgcagatcctcgccggccccgagcatctgaagctgctcgaccagtcggtgaccgtgccgtcccccgccacggacgcgatcggccaggccgcccggcaggcaggaatggtggtgtccatcggcgtcaacgagcgtgacggcggcaccctgtacaacacgcagctgctcttcgacgcggacggcgcgctgatccagcgtcgccgcaagatcaagcccacccactacgagcgcatgatctggggcgagggcgacggctccggcctgcgcgccgtcgacagccaggtcggtcgtatcggccagctggcctgctgggagcacaacaaccccctggcgcgctacgccatgatggccgacggcgagcagatccattcggccatgtatccgggctcgatgttcggcgacccgttcgcccagaagacggaaatcaacatccggcagcatgcgctggaatccggatgcttcgtcgtctgctcgacggcctggttggacgccgatcagcaggcgcaaatcatgcaggacacgggctgcgccatcggcccgatctcgggcggctgcctcacggcgatcgtggcgcccgacggcacgttcctgggcgaaccgctcacgtcgggcgagggcgaggtcatcgccgacctcgatttcaagctgatcgacaagcgcaagcagacgatggactcgcgcggccactacaaccgccccgaactgctcagcctgctgatcgatcgaacgccgacgtcgaacgtccatgagcgcgccgcgcacccgaaggtcgaggcgtcacaaacggctggcgacacggagcggacccgcgaggtcctgtaa

SEQ ID NO: 234 - protein, 333 aa, Unknown
  Obtained from an environmental sample
VSTIVKAAAVQISPVLYSREGTVERVVKKIRELGEKGVQFATFPETVIPYYPYFSFVQTPLQILAGPEHLKLLDQSVTVPSPATDAIGQAARQAGMVVSIGVNERDGGTLYNTQLLFDADGALIQRRRKIKPTHYERMIWGEGDGSGLRAVDSQVGRIGQLACWEHNNPLARYAMMADGEQIHSAMYPGSMFGDPFAQKTEINIRQHALESGCFVVCSTAWLDADQQAQIMQDTGCAIGPISGGCLTAIVAPDGTFLGEPLTSGEGEVIADLDFKLIDKRKQTMDSRGHYNRPELLSLLIDRTPTSNVHERAAHPKVEASQTAGDTERTREVL

SEQ ID NO: 235 - DNA, 993 bp, Unknown
  Obtained from an environmental sample
atgaaaattgttaaagcggcagcagttcagctgagccccgtcctctatagccgcgaggggacggtcgaaagagtagtgcggaagattcatcaacttggtcaacagggagtgcagtttgccaccttcccggaaacagtggtgccttactacccgtatttttcgatcgtgcagtccgggtatcaaatccttcgcggcggtgagttcgtgaagctgctcgatcagtcagtgacggtgccatctcttgccaccgaagcgatcgccgaggcctgcaggcaggcgggcgtcgttgtctccatcggcgtcaatgagcgtgacggcggaactatatacaatgcgcagcttctgtttgattcggacggcacattgattcagaggcgacgcaagatcacgcccacccactacgagcgcatgatctggggccagggcgatggctcgggtctgcgggctgtggacagcaaggtggcacgtattggtcaactggcgtgctttgagcattacaaccccctcgcacgatacgcgatgatcgccgatggcgagcagatccactctgcaatgtttcccggttccatgttcggcgatggtttcgcggagaggaccgagatcgcggtcaggcagcatgcgcaggagtccggatgctttgtagtttgtgctacggcgtggctggatgccgaccagcaggctcaaattgccgcggacacaggcatcaccgacctgggaccgatctccggcggttgcttcactgcgatcattgcacctgatgggagcctgctgggtcaaccaatccgctcgggcgaaggtgacgtcattgtcgatctcgatttcactctgatcgacaggcggaagcatgttgtggactcgagaggtcactacagccggccggaattgctaagcctgctgatcgaccgtactcccacagcgcacgttcacgaacgggccgcgcactctcacttggccgccgagcaatgcttggaggatcttaacgcgcttgcttaa

SEQ ID NO: 236 - protein, 330 aa, Unknown
  Obtained from an environmental sample
MKIVKAAAVQLSPVLYSREGTVERVVRKIHQLGQQGVQFATFPETVVPYYPYFSIVQSGYQILRGGEFVKLLDQSVTVPSLATEAIAEACRQAGVVVSIGVNERDGGTIYNAQLLFDSDGTLIQRRRKITPTHYERMIWGQGDGSGLRAVDSKVARIGQLACFEHYNPLARYAMIADGEQIHSAMFPGSMFGDGFAERTEIAVRQHAQESGCFVVCATAWLDADQQAQIAADTGITDLGPISGGCFTAIIAPDGSLLGQPIRSGEGDVIVDLDFTLIDRRKHVVDSRGHYSRPELLSLLIDRTPTAHVHERAAHSHLAAEQCLEDLNALA

SEQ ID NO: 237 - DNA, 993 bp, Unknown
  Obtained from an environmental sample
atgaaagtcgtcaaagccgccgcagtgcagatcagtcctgttctctacagccgagaggcaaccgtcgccaaggtcgtgcagaagatccacgaactcggccagaaaggcgtgcagttcgccacctttccagagaccgtagtgccttactacccgtacttttccgccgtccagacaggcatcgagcttctgtccggcacggagcatctccggctgctcgatcaggccgtgacggtgccgtctgccgctaccgacgcgatcggagaggcagcccggaaggcaggcatggtggtgtcgatcggcgtcaatgaacgcgatggcggcaccttgtacaacacacagttgctcttcgatgccgatggcaccttgatccagcgccgccgcaagatcacgccgacccacttcgaacgcatgatctggggccagggggacggttcgggcctgcgcgctgtcgacagcaaggtcggtcgcattggccagttggcctgcttcgagcacaacaacccgctggcccgctacgcgttgattgccgacggcgagcagatccattccgccatgtatccgggttctgcttttggcgaaggatttgcccaaaggatggaaatcaatatccgccagcatgcgctggagtcgggtgcgttcgtcgtcaacgcaacggcctggctggatgctgaccagcaggcgcagatcatgaaggacaccggctgcgggattggcccgatctcgggcggttgcttcaccacgatcgtgtcacccgacggcatgctgatggccgaacccctgcgctcgggcgagggtgaggtcatcgtcgatctcgacttcacgctgatcgaccgtcgcaagatgttgatggactcggcgggccactataaccgcccggaactgctcagtctcatgatcgaccgcaccccgaccgcgcacgttcatgaacgcgctgcgcgtccggtgtcgggcgttgagcagaacccggaggaacttcgcatcccggccgcgtga

SEQ ID NO: 238 - protein, 330 aa, Unknown
  Obtained from an environmental sample
MKVVKAAAVQISPVLYSREATVAKVVQKIHELGQKGVQFATFPETVVPYYPYFSAVQTGIELLSGTEHLRLLDQAVTVPSAATDAIGEAARKAGMVVSIGVNERDGGTLYNTQLLFDADGTLIQRRRKITPTHFERMIWGQGDGSGLRAVDSKVGRIGQLACFEHNNPLARYALIADGEQIHSAMYPGSAFGEGFAQRMEINIRQHALESGAFVVNATAWLDADQQAQIMKDTGCGIGPISGGCFTTIVSPDGMLMAEPLRSGEGEVIVDLDFTLIDRRKMLMDSAGHYNRPELLSLMIDRTPTAHVHERAARPVSGVEQNPEELRIPAA

SEQ ID NO: 239 - DNA, 969 bp, Unknown
  Obtained from an environmental sample
atgtccaatgagaataagtatgacacatttaaagttgctgcagtccaggccacacctgtgtttcttgatcgtgaagcaaccatcgacaaagcttgcgagttgattgctactgcaggtcgtgaaggtgctcgcctgattgtctttccagaagcgttcatcccatcctatcccgagtgggtatggggtattccctctggtgagcaaggtttactcaacgaactttattcagagttgctcaccaatgcggttaccatacccagcgacgcgactgacagattgtgcgaggcggcaaagcttgcgaatgcctatgtagtgatgggaatgagcgaacggaatgtcgaagcgagtggtgcaagcctgtataacacgatgttgtatatagatgcacagggggagattttagggaaacatcggaagctggtgccaacgggtggtgaacgcctggtatgggcgcaaggtgatggcagcacgctgcaggtctacgatactccattgggaaaacttggtgggttaatttgctgggaaaattatatgccgctggcacgctatacgatgtatgcctggggaacacaaatctatgttgcagcaacgtgggattgcggccaaccctggctctcaacgatacggcatattgctaaagaaggcagggtatacgtggttggttgctgtatcgcgatgcgtaaagatgatattccagatcgttactctatgaagcagaaatattatgctgaaatggatgaatggataaatgttggggatagcgcgattgtcaatcccgaaggacattttattgcagggcctgtgcgcaagcaagaagaaattctctatgcggagattgatccacgtatgatgcaaggcccgaagtggatgcttgacgtggcgggacattatgcaagaccagatgtgttccagttgacggtgcatacggatgtgaggcagatgatacgggtggaagatgattctcaatga

SEQ ID NO: 240 - protein, 322 aa, Unknown
  Obtained from an environmental sample
MSNENKYDTFKVAAVQATPVFLDREATIDKACELIATAGREGARLIVFPEAFIPSYPEWVWGIPSGEQGLLNELYSELLTNAVTIPSDATDRLCEAAKLANAYVVMGMSERNVEASGASLYNTMLYIDAQGEILGKHRKLVPTGGERLVWAQGDGSTLQVYDTPLGKLGGLICWENYMPLARYTMYAWGTQIYVAATWDCGQPWLSTIRHIAKEGRVYVVGCCIAMRKDDIPDRYSMKQKYYAEMDEWINVGDSAIVNPEGHFIAGPVRKQEEILYAEIDPRMMQGPKWMLDVAGHYARPDVFQLTVHTDVRQMIRVEDDSQ

SEQ ID NO: 241 - DNA, 972 bp, Unknown
  Obtained from an environmental sample
atgatatccaacgagcataacaatactccattcaaggttgctgctgtgcaggctacacctgtgtttcttgatcgcgaagcaacgatcgataaagcgtgtgaactgatcgctactgccggtcatgaaggcgctcgtttgattgtttttccagaagcgttcatcccatcctatcccgagtgggtatggggaattccctctggcgagcaaggtttgctcaacgatctgtatgcagagttactcaccaattcagttacgatacccagcaacgcaactgacaggctttgtagagccgcgaagcttgctaatgcctacgtggtgatggggatgagcgaacggaatatcgaagcgagcggcgcaagcctgtacaatacgatgttatatatagatgcacagggtgagattttgggcaaacatcgaaagctggtgccaacgggcggagaacgcctggtatgggcacaaggagatggaagcacgctgcaggtttacgatacacctctaggaaagcttggtggtttaatttgctgggaaaattatatgccgctggcacgctacgctatgtatgcctggggaactcaaatctacgtcgcggcaacgtgggatcgcggccaaccctggctctcaacgatacggcatatcgctaaagagggcagggtatacgtaatcggttgctgtatcgcgatgcgtaaagacgatattccagataggtactccatgaagcagaagtattatgcggagatggatgaatggatcaacgtaggtgacagcgcgattgtcaatcctgagggggacttcattgcggggcctgtgagcaagcaggaggaaattctctatgcggagattgatccgcggatggtgcaaggtccgaagtggatgctggatgtggcggggcattacgcgaggcctgatgtgttcgagttgacggtgcatacggatgtgagggagatgatgcgggtggagcatgattatcaatga

SEQ ID NO: 242 - protein, 323 aa, Unknown
  Obtained from an environmental sample
MISNEHNNTPFKVAAVQATPVFLDREATIDKACELIATAGHEGARLIVFPEAFIPSYPEWVWGIPSGEQGLLNDLYAELLTNSVTIPSNATDRLCRAAKLANAYVVMGMSERNIEASGASLYNTMLYIDAQGEILGKHRKLVPTGGERLVWAQGDGSTLQVYDTPLGKLGGLICWENYMPLARYAMYAWGTQIYVAATWDRGQPWLSTIRHIAKEGRVYVIGCCIAMRKDDIPDRYSMKQKYYAEMDEWINVGDSAIVNPEGDFIAGPVSKQEEILYAEIDPRMVQGPKWMLDVAGHYARPDVFELTVHTDVREMMRVEHDYQ

SEQ ID NO: 243 - DNA, 999 bp, Unknown
  Obtained from an environmental sample
atgaagcaaactcgagtagcgatcattcaggcggaacctgtatatctcaatttgcaagcgagtgttgcgagggctatcgatcttgccggacgcgccgcgaagcaaggagcgcgtctgatagtgtttggagagacctggttgccgggttatcccgcgtggctggattactgtcccggcatggcgttctgggatcaccggccgacaaaagaagtgtttgcccggacccgcgagaacagtgttgtaattccgggaaaggaaatcgaacagctctgtaaaactgcggcggagctgggagttgtaatttcgatcggtgtaaacgaaaaaattctggaaggccccggaaacggcacgctctacaattctcttttgctgattgatgaatcaggaaaactggccggccatcaccgcaaactggttccgacttatacggaacggatggtgtggggaatgggtgatggaggtggaatggaagccatatcgactgcagccggcagggttggcggattgatttgctgggagcactggatgccattgagccggcaggtgctgcacatgtcgggtgaggaaattcatgtggcagtgtggcccacggttcatgaggtgcaccagcttgcatcacgccattatgcatttgaagggcgttgttttgtgctcgcagccggattgttgatgaaggtccgggatattcctccggagctggaattgccttctcagatgtcgcgtgaatccgaagactggcttctgcgcggcgggagcgccgtcattggtccggatggaaagtacattgtggagccgttgtttgatcgagaggcgattctcacagccgatcttgaattagccgcatgcgatcgtgaaaaaatgacgctggacgtaacgggacattattcccgccccgatctttttcacctggaattcaggaaacagcaatccggccatattgcgggagcaggaacgatcagccggcaaaaatcagcgccggaccgcgcggacgatcactaa

SEQ ID NO: 244 - protein, 332 aa, Unknown
  Obtained from an environmental sample
MKQTRVAIIQAEPVYLNLQASVARAIDLAGRAAKQGARLIVFGETWLPGYPAWLDYCPGMAFWDHRPTKEVFARTRENSVVIPGKEIEQLCKTAAELGVVISIGVNEKILEGPGNGTLYNSLLLIDESGKLAGHHRKLVPTYTERMVWGMGDGGGMEAISTAAGRVGGLICWEHWMPLSRQVLHMSGEEIHVAVWPTVHEVHQLASRHYAFEGRCFVLAAGLLMKVRDIPPELELPSQMSRESEDWLLRGGSAVIGPDGKYIVEPLFDREAILTADLELAACDREKMTLDVTGHYSRPDLFHLEFRKQQSGHIAGAGTISRQKSAPDRADDH

SEQ ID NO: 245 - DNA, 999 bp, Unknown
  Obtained from an environmental sample
atgggtgagaatgccaacttcaccgtcgcagctgtccaggcaacgccggtcttcttagaccgggatgcgacggtcgagaaggcttgcgagctcatcgctgaagccgggcgaaacggagcgcgcctggccgtttttcccgaggcgtttgtgccggcttacccggactgggtctgggctgttccgccgggcgattcaaggctgctgcacgagctctacggtgagctgatccagaactctgtcacgattcccagcgagtcgacggagaaactctgccgggccgcccgcggggccaaagtctgcgtggcgatcggcatcaacgagaggaatgcggaggcaagcgggggtagcctctacaacagcctcctgtacatcagcccggacggccaggtcctcgggaagcaccgcaagctcgttcccaccggagcggagcggcttgtctgggcgcagggcgacggcagcactatcgacgtgtttgagttgcctttctgtcgtttgggtggcctcatctgttgggagaactacatgccgctggcccgttatgcgatgtacgcctggggcacgcaggtctacgtcgcggcaacgtgggaccacggcgaaccttggctctcaaccttgaggcatatcgccagggaggggcgtgcatatgtcattggcgtttgcatgccgatgcgcatgagcgacatcccggaccgatacgagttcaagcgcaagtactatggcgggcgcgactggatcaatactggtgacagcgccatcgtgggtccggacggaaacttcatcgccggccccctgagcgagcgcgaagagatcctgtacgccgatatagacctgaatcggcttgcgaactcgaagtggatgctggacgtcgccgggcactatgcacggccggacgtcttccagttgaccgttaaccgcgagccgaacccgatgatctctgaggatgggcacaagacggttcccacgctaccgaaacgtgcggggaagagtaggacgagatga

SEQ ID NO: 246 - protein, 332 aa, Unknown
  Obtained from an environmental sample
MGENANFTVAAVQATPVFLDRDATVEKACELIAEAGRNGARLAVFPEAFVPAYPDWVWAVPPGDSRLLHELYGELIQNSVTIPSESTEKLCRAARGAKVCVAIGINERNAEASGGSLYNSLLYISPDGQVLGKHRKLVPTGAERLVWAQGDGSTIDVFELPFCRLGGLICWENYMPLARYAMYAWGTQVYVAATWDHGEPWLSTLRHIAREGRAYVIGVCMPMRMSDIPDRYEFKRKYYGGRDWINTGDSAIVGPDGNFIAGPLSEREEILYADIDLNRLANSKWMLDVAGHYARPDVFQLTVNREPNPMISEDGHKTVPTLPKRAGKSRTR

SEQ ID NO: 247 - DNA, 990 bp, Unknown
  Obtained from an environmental sample
atgccgacccccaaggaaaagtttagaatcgccgccgttcaggcttgccccgtttttctggaccggggggagacggtaaagaaggcctgccggctggcggccgaggccgggggccagggcgcccggctgatcgtgtttccggagtccttcatccccgcttacccggactgggtgtgggccgttccgccggggagggagaagctcctgaatgaaatgtacgccgaattcctggccggcgcggtggaagtcccggggccggtgacggaggaattgggccgggcggcggaaagggccggcgcttacctggtcatgggggtcaccgagcgggacaccgaggccagcggggcaagcctgtacaacaccctcctctatttcggtccccagggaagcctgctgggaaaacaccgcaaactggtgcccacgggaggggaacggaccgtctgggcccggggggacggcagcacgctgcaggtgtacgatacccccctgggaaagatcggcggcctgatctgctgggagaactacatgcccctggcccgctacgccatgtatgcgtggggcactcagatttacctggcccccacctgggaccggggggaaccctggctttcaaccctgcggcacatcgccaaggaagggcgggtttacgtggtggggtgctgcatggctatgcaaaaaggggacatcccggatcgcttcgaatacaagcaaaaatactatcccgcagcccgggagtggatcaacacgggcgacagcgccatcctgaacccggagggggaattcatcgccgggccggcgggaaagaaggaagagatcctgtacgctgaaatagacccccggcagatgggggggcccaagtggatgctggacgtggccggccattacgcccggccggatgtcttcgaactgatcgttcaccgggaggcccggccgatgatccgggtgacggaagcgccgtctccgggagagaaagaaacgggtgaaggatag

SEQ ID NO: 248 - protein, 329 aa, Unknown
  Obtained from an environmental sample
MPTPKEKFRIAAVQACPVFLDRGETVKKACRLAAEAGGQGARLIVFPESFIPAYPDWVWAVPPGREKLLNEMYAEFLAGAVEVPGPVTEELGRAAERAGAYLVMGVTERDTEASGASLYNTLLYFGPQGSLLGKHRKLVPTGGERTVWARGDGSTLQVYDTPLGKIGGLICWENYMPLARYAMYAWGTQIYLAPTWDRGEPWLSTLRHIAKEGRVYVVGCCMAMQKGDIPDRFEYKQKYYPAAREWINTGDSAILNPEGEFIAGPAGKKEEILYAEIDPRQMGGPKWMLDVAGHYARPDVFELIVHREARPMIRVTEAPSPGEKETGEG

SEQ ID NO: 249 - DNA, 1017 bp, Unknown
  Obtained from an environmental sample
atgggcattcaacatccgaaatatcgcgtcgcggtggtgcaggcggcaccggcctggctcgacctcgaggcgtcggtcagcaagagcatcgcgctgatagaggaggccgccgccaagggcgccaagctgatcgcgttccccgaggccttcatccccggctatccctggtacatctggctggactcgccggcctgggcgatcggccgcggcttcgtgcagcgctatttcgacaattcgctcagctatgacagcccgcaggcggagcgcctgaggctcgcagtgaagaaggccggcatgaccgcagtgctcggcctgtccgagcgcgacggcggcagcctctatctcgcgcaatggttgatcggacccgacggcgagaccatcgcaaagcggcgcaagctgcggccgacccatgccgagcgcaccgtctacggcgagggcgacggcagcgaccttgcggtgcatgaccgccccggcatcggccggctcggtgcgctgtgctgctgggagcatctgcagccgctgtcgaaatacgcgatgtacgcccagaacgagcaggtgcatgtcgcggcctggccgagcttctcgctgtacgatccgttcgcgccggcgctcggctgggaggtcaacaatgcggcctcgcgcgtctatgccgtcgagggctcctgcttcgtgctggcgccctgcgccaccgtctcgcaggcgatgatcgacgagctctgcgaccgcgacgacaagcatgcgctgctgcatgttggcggcggccatgccgcgatcttcggccccgacggcagcgcgatcgcggacaagcttccgtccgaccaggagggcctcctgttcgccgacatcgatctcggcgcgatcgggatcgcgaagaatgccgctgatccggccgggcactattcgcgcccggacgtgacgcggctgctgctcaacaagaagccctcgaagcgcgtcgagcacttcgcgctgccgctcgacacgctcgcgggcgaggagatcgacgcggccgcaagctaa

SEQ ID NO: 250 - protein, 338 aa, Unknown
  Obtained from an environmental sample
MGIQHPKYRVAVVQAAPAWLDLEASVSKSIALIEEAAAKGAKLIAFPEAFIPGYPWYIWLDSPAWAIGRGFVQRYFDNSLSYDSPQAERLRLAVKKAGMTAVLGLSERDGGSLYLAQWLIGPDGETIAKRRKLRPTHAERTVYGEGDGSDLAVHDRPGIGRLGALCCWEHLQPLSKYAMYAQNEQVHVAAWPSFSLYDPFAPALGWEVNNAASRVYAVEGSCFVLAPCATVSQAMIDELCDRDDKHALLHVGGGHAAIFGPDGSAIADKLPSDQEGLLFADIDLGAIGIAKNAADPAGHYSRPDVTRLLLNKKPSKRVEHFALPLDTLAGEEIDAAAS

SEQ ID NO: 251 - DNA, 978 bp, Unknown
  Obtained from an environmental sample
gtgaccatcgtgagagctgccgccgtgcagatcagtcccgtgctctacagccgggaagccaccgtagaaaaagtcgttcgcaagatccgcgaactgggaagaaacggcgtgcagttcgccaccttcccggaaaccctggtgccctactacccgtacttcgcggccgtgcagacgggcatcgaactgctgtccggcaaggagcacctgcgactgctggaacaatccgtaacggttccctcgcccgccaccgatgccattgcccaggcggcacgcgaagccggcatggtggtgtccatcggtgtcaacgagcgcgacggaggcaccatctacaacacgcagctgctgtttgacgccgacggcacgctggtacagcgccgccgcaagatcacgccgacgcatttcgagcgcatggtctggggccagggcgacggctcgggcctgcgagccgtggacaccaaggccggccgcatcggtcagctcgcctgcttcgagcacaacaacccgctggcgcgctacgccatgatcgccgacggtgagcagatccattcggccatgtacccgggctctgccttcggcgagggcttcgcgcagcgcatggaaatcaacatacgccagcacgccctggagtctggctgcttcgtggtgaatgcgaccgcgtggctggatgccgaccagcaggcgcagatcatgaaggatacgggctgcggcatcggcccgatctccggcggctgcttcacgaccatcgtcacgccggacggcatgctgatcggtgaacccctccgcgaaggcgaaggcgaagtcatcgccgacctcgatttcaccctgatcgaccggcgcaagctgctggtggactcggtgggccactacaaccgtccggagctgctgagcctgctgatcgatcgcacccctgcggcgaacttccatgagcgcaatgcgcttccgtccgtcaacaccgccagcagcctcgaaatcgtctga

SEQ ID NO: 252 - protein, 325 aa, Unknown
  Obtained from an environmental sample
VTIVRAAAVQISPVLYSREATVEKVVRKIRELGRNGVQFATFPETLVPYYPYFAAVQTGIELLSGKEHLRLLEQSVTVPSPATDAIAQAAREAGMVVSIGVNERDGGTIYNTQLLFDADGTLVQRRRKITPTHFERMVWGQGDGSGLRAVDTKAGRIGQLACFEHNNPLARYAMIADGEQIHSAMYPGSAFGEGFAQRMEINIRQHALESGCFVVNATAWLDADQQAQIMKDTGCGIGPISGGCFTTIVTPDGMLIGEPLREGEGEVIADLDFTLIDRRKLLVDSVGHYNRPELLSLLIDRTPAANFHERNALPSVNTASSLEIV

SEQ ID NO: 253 - DNA, 924 bp, Unknown
  Obtained from an environmental sample
atgtcaaacgagaaccacaaccaaacattcaaagttgccgcggtgcaggccacacctgtattcctcgatcgtgaagcgaccatcgacaaagcttgcgagttgattgctgcagccggcaatgaaggggcgaggctggttgtcttcccggaggcattcatcccgtcctatccagattgggtatgggcaatcccaccgggcgaagaaggcgtgctcaatgagttgtacgcggaactgctctccaattcggtcacgattcccagtgacgtgacggatagactgtgccgggccgcgaggcttgccaatgcctacgtagtgatggggatgagcgaatgcaatgccgaggccagtggcgcaagcctgtataacacgctattgtacatcgatgcgaagggtgaaatcctgggtaaacatcgaaagttggtgccaactggcggcgagcgactggtgtgggcacagggcgatggcagcacgctgcaggtctacgatactccactgggtaaactcggcggtttaatttgctgggagaattatatgccgctggcccgctacaccatgtacgcctggggcacacaaatctatatcgcagcgacatgggatcgcgggcaaccctggctctccaccttgcggcatatcgccaaagaaggcagggtgtacgtgatcggctgttgtatcgcgatgcgcaaagatgatatcccagagcgttacccaatgaagcagaagttttacgcggaggccgatgagtggatcaatataggcgacagcgcgatcgtcaatcctgaagggcagtttatcgcggggccggtacgcaaacaggaagagattctctacgcggagattaatccgcgcatggtgcaaggcccgaagtggatgctcgacgtggcagggcactacgccaggccggacgtattccagttgacagtgtaa

SEQ ID NO: 254 - protein, 307 aa, Unknown
  Obtained from an environmental sample
MSNENHNQTFKVAAVQATPVFLDREATIDKACELIAAAGNEGARLVVFPEAFIPSYPDWVWAIPPGEEGVLNELYAELLSNSVTIPSDVTDRLCRAARLANAYVVMGMSECNAEASGASLYNTLLYIDAKGEILGKHRKLVPTGGERLVWAQGDGSTLQVYDTPLGKLGGLICWENYMPLARYTMYAWGTQIYIAATWDRGQPWLSTLRHIAKEGRVYVIGCCIAMRKDDIPERYPMKQKFYAEADEWINIGDSAIVNPEGQFIAGPVRKQEEILYAEINPRMVQGPKWMLDVAGHYARPDVFQLTV

SEQ ID NO: 255 - DNA, 1005 bp, Unknown
  Obtained from an environmental sample
atgacaatgtctaagaccaaatttagggttgcagctgtgcaggcggcgccggttttccttgatcgggaagcgacgttggataaagcttgtggattgattgaggaggcgggccgcaacggcgccagcctcgtcgtcttccctgagtcattcattccggcctaccccgattgggtttgggctgtgccggcgggcgaagaagctttactcaatgaactgtacgcacaactgttggccaacgccgttgaaattcccggcccggccactcaacgtttgagccaggcggctaaaaaggctaaggttcacctggctatgggcctgaccgaacgcaacagcgaggccagcggcggcagcctttacaacaccttgctctatcttgacccgcagggccacattctgggcaagcatcgtaagctggtgcccaccggcggtgagcggctggtttgggcccagggcgacggcagcactttgcaagtttacgatacgcctctgggtaaactcagcggcctgatttgctgggaaaattatatgccgctggcgcgctacgcgctgtatgcctggggtacgcaaatttatattgcggccacctgggatcggggtgagccgtggctttcgacgttgcggcatattgccaaagagggccgggtgttggtcatcggttgcggtatggccttgcgcaaggctgatattcctgatcattttgaattcaagcagcgcttttatcaaaacgccgccgagtggatcaacgggggcgacagcgccattgtcaaccctgatggtgaatttattgctggccccttaagcgagcaggaaggcattttgtacgccgagattgatccggcccagatgggcgggccaaagtggatgctcgacgtggccgggcattacgctcgcccggatgtgtttgaactgacggtccataccgccgcccgacccatgatcacctcgaaaaaggatggcctaacacccgccgaggccgttacgcaagtaacgaaagcattattgtaa

SEQ ID NO: 256 - protein, 334 aa, Unknown
  Obtained from an environmental sample
MTMSKTKFRVAAVQAAPVFLDREATLDKACGLIEEAGRNGASLVVFPESFIPAYPDWVWAVPAGEEALLNELYAQLLANAVEIPGPATQRLSQAAKKAKVHLAMGLTERNSEASGGSLYNTLLYLDPQGHILGKHRKLVPTGGERLVWAQGDGSTLQVYDTPLGKLSGLICWENYMPLARYALYAWGTQIYIAATWDRGEPWLSTLRHIAKEGRVLVIGCGMALRKADIPDHFEFKQRFYQNAAEWINGGDSAIVNPDGEFIAGPLSEQEGILYAEIDPAQMGGPKWMLDVAGHYARPDVFELTVHTAARPMITSKKDGLTPAEAVTQVTKALL

SEQ ID NO: 257 - DNA, 942 bp, Unknown
  Obtained from an environmental sample
atgaacaagatcgcgatcattcagcgcccacccgtgctactcgaccgcatcgccacgctggcggttgcggtggagtcgatcgacgaagctgccgcagccggtgcctcactgatcgttcttccagaaaccttcatccccggctacccgtcctggatctggcgtctcgcgccggggagggatggtgcgctcattgcccagttgcatgcccgactgctcgccaacgcggtcgatcttgcggctggagatctggatgccctgtgtgaagttgcgcacggccaccgggtgaccgtggtgtgcggcctcaacgaatgcgagcgcagtcgcggcgggggcactctctacaacacggtcgtcgtgatcgaccccgacggcaagctgtgcaatcgccaccgcaagctgatgccgaccaacccggaacgcatggtgcacggtctgggtgatgcatcgggcctgcgcgccgtcgacaccccggtgggtcgagtgggcgcactcatctgctgggaaaactatatgccgctggcacgctacgcactttacgccgagggggtggaagtctacgtggcgcccacctatgacagcggcgatggctggatcagtacgatgcgtcatattgcgcttgagggacgctgctgggtgctgggtagcggaaccgtactgcgtggcagcgacgtcccagaagactttccgtcacacctggacctgtttcccgacgcggaggaatggatcaatccgggcgactcggtggtcgtcgatcctcagggcaagatcgtcgcaggcccgatgcgacgtgagacaggcattctctacgcagaaatcgacgccgaacgggtcgcgccttcgcgccgcacgctcgatgtcgccggacactacgcccgcccggatattttcgagctccatgtccgacgtacgccggcgatgccggtccacgccgttgatgcatga

SEQ ID NO: 258 - protein, 313 aa, Unknown
  Obtained from an environmental sample
MNKIAIIQRPPVLLDRIATLAVAVESIDEAAAAGASLIVLPETFIPGYPSWIWRLAPGRDGALIAQLHARLLANAVDLAAGDLDALCEVAHGHRVTVVCGLNECERSRGGGTLYNTVVVIDPDGKLCNRHRKLMPTNPERMVHGLGDASGLRAVDTPVGRVGALICWENYMPLARYALYAEGVEVYVAPTYDSGDGWISTMRHIALEGRCWVLGSGTVLRGSDVPEDFPSHLDLFPDAEEWINPGDSVVVDPQGKIVAGPMRRETGILYAEIDAERVAPSRRTLDVAGHYARPDIFELHVRRTPAMPVHAVDA

SEQ ID NO: 259 - DNA, 981 bp, Unknown
  Obtained from an environmental sample
atggccatcatcaaagccgccgccgtccagatcagtccggtgctgtatagccgcgagggaaccgtggacaaggtctgccagcagatcatcgccctcggtcagcaaggcgtgcaatttgcggtctttccggaaacggtggtgccgtactacccctatttctccttcgtccagccgccgttcgccatgggcaaggaacacctgaaactgttggaacaatcggtgattgtgccgtcggctgccaccttggcgatcggcgaagcgtgcaaacaagcgggaatggtggtgtctatcggcgtcaatgagcgcgatggcggcacgatctacaacgcccagttgctgtttgacgctgatggcagcttgattcagcaccgtcgcaaaataaccccgacgtaccacgagcggatgatctggggtcaaggcgacggctccgggttgcgcgccatcgacagcgcggtcgggcgtattggctcgctggcctgctgggaacattacaaccccttggcccgctacgccctgatggccgacggcgagcagattcacgcggctatgtttcccggctctctggtgggtgacatttttgccgatcagatagaggtcactattcgtcatcacgccttggagtccggctgcttcgtggtcaactccaccgcgtggcttgatgctgatcagcaaggccaaatcatgcaggacaccggttgcagcattggcccaatctcgggtggctgcttcacggccatcgtttccccggaaggcaaattactcggcgaaccgctgcgttcaggtgagggcgcagtcatcgccgacctggacatggcattgatcgacaagcgcaaacggatgatggattccgtcggccattacagccgcccagaactgctcagtttattgatcgaccgcacgcccaccgctcatgtgcatgagcgcggcgcccatcaccttgccgtagcctctatcggggagcttgaccatgcaaaccaatga

SEQ ID NO: 260 - protein, 326 aa, Unknown
  Obtained from an environmental sample
MAIIKAAAVQISPVLYSREGTVDKVCQQIIALGQQGVQFAVFPETVVPYYPYFSFVQPPFAMGKEHLKLLEQSVIVPSAATLAIGEACKQAGMVVSIGVNERDGGTIYNAQLLFDADGSLIQHRRKITPTYHERMIWGQGDGSGLRAIDSAVGRIGSLACWEHYNPLARYALMADGEQIHAAMFPGSLVGDIFADQIEVTIRHHALESGCFVVNSTAWLDADQQGQIMQDTGCSIGPISGGCFTAIVSPEGKLLGEPLRSGEGAVIADLDMALIDKRKRMMDSVGHYSRPELLSLLIDRTPTAHVHERGAHHLAVASIGELDHANQ

SEQ ID NO: 261 - DNA, 1014 bp, Unknown
  Obtained from an environmental sample
atgggtctggttcatcagaaatacaaggtagcggtggttcaggcggcaccggtttttctcgatctcgatgcaaccgtggacaagaccattgcgctgatcgaggaagcttccgcgcaaggcgcaaaactggtcgcgtttcccgagaccttcattcccggatatccgtggcagatctggctcggcgcgccggcctgggcgatcggccgcggctttgtgcagcgctacttcgacaattcgctgggcttcgacagcccgcaggcggaaaaaatccgccaggccgtgaagcgcgccaagctgaccgcggtgcttgggctatccgaacgcgacggcggcagcctctatatcgcgcagtggctgatcggccctgacggcgagaccatcgccaagcgccggaaactgcgtccgacccatgccgaacgcaccgtgttcggcgaaggcgacggcagcgatcttgcggtccacgatcgcgccgacgtcgggcgcttgggcgcactgtgctgctgggagcacctgcagccgctatcgaaatacgcgatgtacgcccagaacgaacaggtgcatgtcggcgcctggccgagcttttcgctgtacgatccgttcgcacatgcgctcggccatgaggtcaacaacgccgccagcaaggtctatgcggtcgaaggctcctgcttcttcctgggtccctgcgctgtcgtctcgcaggcgatgatcgacgagctctgcgactctcccgagaaacatgccttcctgcatgtcggcggcggccacgcggtgatctacggcccggacggcagttcgctggccgagaaactcccgcccgaccaggaaggcattctgtacgccgatatcgatctcggcatgatcggggtcgcgaagaacgccgccgatccggccgggcattattcgcggcccgacgtcacgcggctgttgctcaacaccacgcgcgccaaccgcgtcgagcatttctcgcttcccgtcgatgccgaggtcatgagcgaaatcaggctgcaggcctga

SEQ ID NO: 262 - protein, 337 aa, Unknown
  Obtained from an environmental sample
MGLVHQKYKVAVVQAAPVFLDLDATVDKTIALIEEASAQGAKLVAFPETFIPGYPWQIWLGAPAWAIGRGFVQRYFDNSLGFDSPQAEKIRQAVKRAKLTAVLGLSERDGGSLYIAQWLIGPDGETIAKRRKLRPTHAERTVFGEGDGSDLAVHDRADVGRLGALCCWEHLQPLSKYAMYAQNEQVHVGAWPSFSLYDPFAHALGHEVNNAASKVYAVEGSCFFLGPCAVVSQAMIDELCDSPEKHAFLHVGGGHAVIYGPDGSSLAEKLPPDQEGILYADIDLGMIGVAKNAADPAGHYSRPDVTRLLLNTTRANRVEHFSLPVDAEVMSEIRLQA

SEQ ID NO: 263 - DNA, 1014 bp, Unknown
  Obtained from an environmental sample
atgaaagtcgtcaaagcggcagcggttcagttgagccctgtcctctacagccgcgaggcaaccgtcgcgaaggtcgtgcggaagatccacgagcttgggcagcagggcgtgcagttcgccaccttcccggaaaccgttgtgccgtactacccgtatttctccgcggtccagacgccgatgcagcttctggctggaaccgagcatctgaaattgctcgaccaggccgtgacggtgccgtctcccgcgaccgacgcgatcggcgaggcagcccggaaggcgggcatggtggtgtccatcggcgtcaacgagcgtgatggtggaaccctgtacaacacccaattgctcttcgacgccgatggcaccctgatccagcgccgccgcaagatcacgcccacccatttcgagcgcatgatctggggccagggtgacgggtcgggcctgcgtgccgtcgacagcaaggtcggccgcattggccagctggcatgcttcgagcacaacaatcctctggcgcgctacgcgatgatggccgacggcgagcagatccattcggccatgtatccgggttctgccttcggcgagggctttgcccagaggatggaaatcaatatccgccagcacgcactggagtccgggtgcttcgtcgtgaacgcgacggcctggctggatgccgaccagcaggcgcaaatcatgaaagacacgggctgcgggatcggtccgatctcgggcggttgcttcaccacgatcgtggcacccgacggcacgctgctgggggaacctctgcgctcgggcgagggcgaggtcatcgccgatctcgatttcacggagatcgaccggcgcaagatgctgatggactcggcaggccactacaaccgtccggaactgctcagtctgctgatcgaccgcacgccgaccgcaaacgtgcacgaacggatggcgcatccccaagcgagcacgaagcagccgcgctccggcgatctgcccgctgcgctggctggcgcgcaggagatcctgtga

SEQ ID NO: 264 - protein, 337 aa, Unknown
  Obtained from an environmental sample
MKVVKAAAVQLSPVLYSREATVAKVVRKIHELGQQGVQFATFPETVVPYYPYFSAVQTPMQLLAGTEHLKLLDQAVTVPSPATDAIGEAARKAGMVVSIGVNERDGGTLYNTQLLFDADGTLIQRRRKITPTHFERMIWGQGDGSGLRAVDSKVGRIGQLACFEHNNPLARYAMMADGEQIHSAMYPGSAFGEGFAQRMEINIRQHALESGCFVVNATAWLDADQQAQIMKDTGCGIGPISGGCFTTIVAPDGTLLGEPLRSGEGEVIADLDFTEIDRRKMLMDSAGHYNRPELLSLLIDRTPTANVHERMAHPQASTKQPRSGDLPAALAGAQEIL

SEQ ID NO: 265 - DNA, 999 bp, Unknown
  Obtained from an environmental sample
atgcttaatctaggcatagtccagatgaacgcagagccgctcaacgtggaaggcaacctgctcaaggcggagcgctatgtcgcgaagtgcgccgcggacggcgcccaactcgtggtgctgccggagatgttcaacgtcggcttccacctcggcgagtccctgatgatggtcgccgagcccctggacggcaagaccgtgcagtggctgcaacggcaggcgtccacccataacatatatatcaccgggagcttatacgagcgttacgacgagcatttctacaacaccatggtcatggtgggatacgacggcagcgtgcagtactaccgcaagcgcaatcctacctggtccgagtcggcggtgtggcgccgcagcgaggtgccaggccccggtatattcgataccccgttcgggcgcatcgggggcgtcatctgcttcgattccttcgcgcgcgagacccacgagggcttcaagcagagcggggtcgaggcggtggtaatcatcgccctgtggggcgccaaccgtgcgcgggcattcttctggcgcccggacctcctgctaagccgggaagggctggtccgttggtcccggctggcctcggaggacgtcccccgaaatcacgcgaaagagctcggggtcccggtcgccttcgtcaaccagagtggcaccatccgcatgaccagccccatccctttccccgactggccggtgcagagctccttctacgacttcatcggcaagtcccacgtccgggacgcatccggagaggtgatcgcgagggtggacgagggggagatcgactcctgcctggtggtcccggtagaggtcgagcaggcgcagagcaggccggagatcaggaagtcaaatatatcgcccggctacctcggcaaggattactatttcgtggagccgccgcttatctgcaagctcttccaggtctggttcctcagcggcctggtgcccaccgaatacgaggcgcggcgtctgcgccacctgttctga

SEQ ID NO: 266 - protein, 332 aa, Unknown
  Obtained from an environmental sample
MLNLGIVQMNAEPLNVEGNLLKAERYVAKCAADGAQLVVLPEMFNVGFHLGESLMMVAEPLDGKTVQWLQRQASTHNIYITGSLYERYDEHFYNTMVMVGYDGSVQYYRKRNPTWSESAVWRRSEVPGPGIFDTPFGRIGGVICFDSFARETHEGFKQSGVEAVVIIALWGANRARAFFWRPDLLLSREGLVRWSRLASEDVPRNHAKELGVPVAFVNQSGTIRMTSPIPFPDWPVQSSFYDFIGKSHVRDASGEVIARVDEGEIDSCLVVPVEVEQAQSRPEIRKSNISPGYLGKDYYFVEPPLICKLFQVWFLSGLVPTEYEARRLRHLF

SEQ ID NO: 267 - DNA, 1038 bp, Unknown
  Obtained from an environmental sample
atgggcattacgcatccgaagttcaaggccgcggcggtacaggcggcgccgggctttctcgacagcgaggccaccgtcgacaagacgatccgcctgatgcaggaagcggcggaccacggcgcctcgctgatcgtctttccggaagcctggctgcccggttatccgtggtggatctggctcggtccgcccgcctggggcatgcagttcgtgcagcgctacttcgacaattcgccgagcgtcggcgatgatcttttccgccggatcgagcgcgcggccgccaaggcgaagatcgaagtggtcctcggtctcagcgagcgcgctgccggctcgctgtacctcgcgcaggcgttcatctcctcaacgggcgagacgcgcgcagtgcgccgcaagttgcgaccaacgcacgtcgagcgaaccgttttcggcgagggcgatggcagcgacttcaaggtgttcgacactccgctgggccgcgtcggtggtctcttgtgctgggaacacctgcaaccgctgtcgcgctacgcgatgttctcgatgaacgagcaggtgcacgccgccgcctggccgacgttcagcctctacacggattttgcccatgccctcggccacgaactgaatctcgcagccagcgctacttacgcggctgaagggcagtgctacgtgattgccgcctgtggcgtggtcacgcaggagatgctggatctgatgaaggcgccgtgccccccggaatatctgcgggtcggcggcggatacgccatgatctttgcgcccgacggacggcgcattgcggcggcgctgccgccggaacaagaagggctgatttacgccgacatcgatctttcgatgatctctctcgccaaggcggctgccgatcccaccggtcactactcgcggccggatgtcgtgcggcttatgctgaataccgaaccgatgcagcgggtcgaaaagctgcagccgccgctggactcagccgcgcgccgtgagaatgaaccggcacgcgagaccgcagcggcgaccgagagccgccagccccagtaa

SEQ ID NO: 268 - protein, 344 aa, Unknown
  Obtained from an environmental sample
MGITHPKFKAAAVQAAPGFLDSEATVDKTIRLMQEAADHGASLIVFPEAWLPGYPWWIWLGPPAWGMQFVQRYFDNSPSVGDDLFRRIERAAAKAKIEVVLGLSERAAGSLYLAQAFISSTGETRAVRRKLRPTHVERTVFGEGDGSDFKVFDTPLGRVGGLLCWEHLQPLSRYAMFSMNEQVHAAAWPTFSLYTDFAHALGHELNLAASATYAAEGQCYVIAACGVVTQEMLDLMKAPCPPEYLRVGGGYAMIFAPDGRRIAAALPPEQEGLIYADIDLSMISLAKAAADPTGHYSRPDVVRLMLNTEPMQRVEKLQPPLDSAARRENEPARETAAATESRQP

SEQ ID NO: 269 - DNA, 1014 bp, Unknown
  Obtained from an environmental sample
atgtctgaaacagccttcaagatcgcggtcgtacaggcggctccggtttttctcgacgcaaaggcgacggtggacaaggcgatcggtctgatggccgaagccggcgccaagggcgccaagctgctcgcattcccggaagtattcatccccggctacccttggtggctgtggctgggcacaccggcatggggcatgcagtttgttgccaagtatcacgcgaactcgcttcgtgcagacgggcctgaattggcagccctcgcggcggcggcggcgaagtccgatatcaatgccgtcatcggcttctcggagatcgacggcggttccctctacatcagccaggcgctcatcagcgacaagggcgagataatgttcaaacggcgcaagctgaagccgacgcacgtcgaacgcacgttgttcggcgaaggggacgggtccgacttccaggtcgtggacacgagcgtcggcaggctcggtgccttgtgttgcgccgaacacatacagccgctgtcgaagtacgcgatgtactccatgcacgaacaggtgcacgtcgcctcctggccgtcatttactttgtaccgcggcacggcatatgccttgggccacgaggtcaatctggccgcgagccagatttatgcgctcgagggaggctgtttcgtccttcatgcgagcgccatcaccggccaggacatgtttgacgtgctgtgcgacactccggagaggacgcaactgctgaactccgacggcggcaaggtcggcggcggctactcgatgatcttcggtcccgatggccagccccttgttgggcatctgcctcaagacaccgagggaatactctacgcagatattgacctggcgaacatttccgttgccaaagcggcctacgacccgtccggacactatgcgcgcggagacgtggtgcgcttgatggtcaatcgcaacccgcggcatacgagtgttgcgttcggcgggggcgccggcgaggcagcaacctggacggaagcaaaagcggagtga

SEQ ID NO: 270 - protein, 337 aa, Unknown
  Obtained from an environmental sample
MSETAFKIAVVQAAPVFLDAKATVDKAIGLMAEAGAKGAKLLAFPEVFIPGYPWWLWLGTPAWGMQFVAKYHANSLRADGPELAALAAAAAKSDINAVIGFSEIDGGSLYISQALISDKGEIMFKRRKLKPTHVERTLFGEGDGSDFQVVDTSVGRLGALCCAEHIQPLSKYAMYSMHEQVHVASWPSFTLYRGTAYALGHEVNLAASQIYALEGGCFVLHASAITGQDMFDVLCDTPERTQLLNSDGGKVGGGYSMIFGPDGQPLVGHLPQDTEGILYADIDLANISVAKAAYDPSGHYARGDVVRLMVNRNPRHTSVAFGGGAGEAATWTEAKAE

SEQ ID NO: 271 - DNA, 966 bp, Unknown
  Obtained from an environmental sample
atgtccagcgagaataacaacgctacattcaaagttgccgcagttcaggccacacctgtgtatcttgatcgtgaagcaaccatcgacaaggcttgcgagttgatcgctactgctggcagcgaaggagctcgcctgattatctttccagaagcgttcatcccaacctatcctgagtgggtatggggtattccttctggtgagcaaggtttactcaacgagctctattcagagttgctcaccaattcggtcacgattcccagcgacgcgactgacagactgtgcgaggccgcgaagcttgctaatgcctacgtggtgatgggaatgagtgaacggaatgtcgaagcgagtggtgcaagcctgtataatacgctcttgtacatagatgcgcagggggagattttagggaaacatcgaaagttggtaccaacgggcggtgagcgcctggtatgggcgcaaggtgatggcagcacgctgcaggtctacgatactccattgggaaaactcggtggtttaatttgctgggaaaattatatgccactggcacgctacgctatgtatgcctggggtacacaaatctatgtcgcagcaacgtgggatcgcggccaaccctggctctcaacgttacggcatattgccaaagaaggcagggtatacgtaattggttgctgtattgcgatgcgtaaagatgatattccagatcgttactccatgaagcagaagtattacgctgaaatggaggaatggattaatattggtgacagcgcgattgtcaatcccgaaggacactttattgcagggcctgtgcgcaagcaagaagaaattctttacgcggagatcgatccacgcatggtgcaaggcccgaagtggatgctcgatgtggctgggcactatgcgagaccagatgtgttccagttgacggtgcatacggatgtgaggcagatgattcgggtggaacatgattcataa

SEQ ID NO: 272 - protein, 321 aa, Unknown
  Obtained from an environmental sample
MSSENNNATFKVAAVQATPVYLDREATIDKACELIATAGSEGARLIIFPEAFIPTYPEWVWGIPSGEQGLLNELYSELLTNSVTIPSDATDRLCEAAKLANAYVVMGMSERNVEASGASLYNTLLYIDAQGEILGKHRKLVPTGGERLVWAQGDGSTLQVYDTPLGKLGGLICWENYMPLARYAMYAWGTQIYVAATWDRGQPWLSTLRHIAKEGRVYVIGCCIAMRKDDIPDRYSMKQKYYAEMEEWINIGDSAIVNPEGHFIAGPVRKQEEILYAEIDPRMVQGPKWMLDVAGHYARPDVFQLTVHTDVRQMIRVEHDS

SEQ ID NO: 273 - DNA, 1023 bp, Unknown
  Obtained from an environmental sample
atgaataactcaccaccaaccatccgcgctgctgccattcagctcagtccagttctgtttagtcgggatgggactaccgagaaggtgttgcaggcgatcgctagtgctgccaaggaaggggcacaactggttgtttttccagaaactttcatcccctactacccctatttctcattcattcaaccccctgtgttgatgggcaaagagcacatgcggctctatgaggaagccgtgacggtcccgggtccggtgacagatgcggtcagtcgagcagcccgttcttacggcatggtggtagtgctgggggtgaatgagcgagatggtggctcaatttacaatacacagttgattttcgatgctgacggcacattgttgctgaagcgacgcaaaatcacccctacctatcatgagcgcatggtctgggggcagggagacggtgctggattgaaggtattggatacagcagtcggtaaggtgggtgcgctggcatgttgggaacattacaatcccctggcacgatttgcgctgatggcacagcatgagcagattcactgcgctcagttccccggttctctggtgggacaaattttcactgatcagattgaggtaacgattcggcatcatgcgttggaatcgggttgttttgtggtgaatgctactggctggctctctccagaacaggtggcacaaatcaccacggatgaaaagttgcaacgggtgctgagtggcgggtgtaataccgccattattggacctgaaggcaatcatctctgtcctcccattaccgatggtgagggcatagcgatcgccgatctcgacttctcactaatcaccaaacgcaaacgcatgatggattgcgtcggtcactactcccgccctgacttgttgaagctgcaactcaatgcaacggcatggtcggtgctggctggggagcagggggcaggtgccagggagcaggggctaggtgtgccggatgccatgctgtctacgcctaagccagaatactcaacactggatcagtag

SEQ ID NO: 274 - protein, 340 aa, Unknown
  Obtained from an environmental sample
MNNSPPTIRAAAIQLSPVLFSRDGTTEKVLQAIASAAKEGAQLVVFPETFIPYYPYFSFIQPPVLMGKEHMRLYEEAVTVPGPVTDAVSRAARSYGMVVVLGVNERDGGSIYNTQLIFDADGTLLLKRRKITPTYHERMVWGQGDGAGLKVLDTAVGKVGALACWEHYNPLARFALMAQHEQIHCAQFPGSLVGQIFTDQIEVTIRHHALESGCFVVNATGWLSPEQVAQITTDEKLQRVLSGGCNTAIIGPEGNHLCPPITDGEGIAIADLDFSLITKRKRMMDCVGHYSRPDLLKLQLNATAWSVLAGEQGAGAREQGLGVPDAMLSTPKPEYSTLDQ

SEQ ID NO: 275 - DNA, 849 bp, Unknown
  Obtained from an environmental sample
atggagacggctcacaaagcaaaggtcgatttccttgtgctgggtgagacgtggctctcaggctacccggcttggctggaccactgccccgatgttggccggtgggattatgaaccgatgaaaaaagtgtatttgagatttcgacaaagtgctatttctgttcctggcaaagaatttgatttccttactggcctctgtaaaaaatattcacaaacgcttgccatcggtgttaatgagaaagtagatcatggggtaggtaatggtaccatttataattcatttctactgattgattctgatggaacactgttgaatcatcatcgcaagttagttcccacttttactgagaaattattatacggccatggagatggccatgggctgaagtcgatggatacttcggtgggaagaatcggagggagcatttgttgggaacattggatgccactatgcagacaagcacttcatgatgcaggtgagcaaatccatgttgccctttggccgactgttcatgacatccatcaagtggcaagtagaagctatgcatttgaagggcgctgctttgtattggctgccgggcagatttttgctgctaaagattttccaaaggaacttgtcttaccagactatctaaagcaaaatccggatcagctcattttgaatggggggagctgcgtgatcggccctgatgggaaatatttgattgagcccgtgtttgatcgggaagaactgattgtgtgtgaacttgaccttgacgaagcttataaagaaagaatgacgatggacgtttcaggtcactaccaaagacgagacgttttcagttttgacgtgaaccaacatcgacattga

SEQ ID NO: 276 - protein, 310 aa, Unknown
  Obtained from an environmental sample
MTKLKIAIGQFSSNHLDLKCSLEKLEKIMETAHKAKVDFLVLGETWLSGYPAWLDHCPDVGRWDYEPMKKVYLRFRQSAISVPGKEFDFLTGLCKKYSQTLAIGVNEKVDHGVGNGTIYNSFLLIDSDGTLLNHHRKLVPTFTEKLLYGHGDGHGLKSMDTSVGRIGGSICWEHWMPLCRQALHDAGEQIHVALWPTVHDIHQVASRSYAFEGRCFVLAAGQIFAAKDFPKELVLPDYLKQNPDQLILNGGSCVIGPDGKYLIEPVFDREELIVCELDLDEAYKERMTMDVSGHYQRRDVFSFDVNQHRH

SEQ ID NO: 277 - DNA, 1056 bp, Unknown
  Obtained from an environmental sample
atgccaacccccagcgatcatttcaaaatcgccgctgttcaggcctcgcccgtgtttctggaccgggaggccactgtggaaaaggcctgccggttgatcgccgaagccgcaaagcagggcgcccgcctcatcgtctttccggaatctttcatcccgacctacccggactgggtatgggccgttcccccgggaagggaaagaatcctgaaccagctgtattctgaattcctggccaatgccgtcgatgttcccggcgcggcgaccgaacaacttgcccaggctgcacgaatggccggcgcctatgtgattatgggcgtcaccgaaagagacacctcggccagcggggccagcctctacaacaccctgctctacttcagccccgaaggcatcctaatgggcaaacaccggaagctggttcccacggggggcgaacggctggtctgggcctacggagacggcagcacgctggaggtctacgacactccgctgggaaagatcggcgggctgatctgctgggagaactacatgcccctggcccggtacacgatgtacgcctggggcacccagatttacatcgccgccacctgggaccgcggggaaccgtggctctccaccctgcggcatatcgccaaggaaggaagggtctacgtcatcgggtgctgcatcgccctgcgccagggggatatcccggaccggttcgagtacaagggaaaattttattccgggtcccgggagtggatcaatgagggcgacagcgccatcgtgaacccggacggggaattcatcgccgggccggtgcggatgaaggaggagatcctgtatgccgagatagacccccggcagatgcggggccccaagtggatgctcgatgtggccggtcattacgcccggccggatatcttcgagctcatcgtccaccggaatccccacccgatgatcaaaatcgccgaagacaggggcgcggggatcgcctcaagtttgattcgcccccgccctaaccttcccccatcaagggggaggaaatcggcaagaagcaaacgcaagcccaaaaaatga

SEQ ID NO: 278 - protein, 351 aa, Unknown
  Obtained from an environmental sample
MPTPSDHFKIAAVQASPVFLDREATVEKACRLIAEAAKQGARLIVFPESFIPTYPDWVWAVPPGRERILNQLYSEFLANAVDVPGAATEQLAQAARMAGAYVIMGVTERDTSASGASLYNTLLYFSPEGILMGKHRKLVPTGGERLVWAYGDGSTLEVYDTPLGKIGGLICWENYMPLARYTMYAWGTQIYIAATWDRGEPWLSTLRHIAKEGRVYVIGCCIALRQGDIPDRFEYKGKFYSGSREWINEGDSAIVNPDGEFIAGPVRMKEEILYAEIDPRQMRGPKWMLDVAGHYARPDIFELIVHRNPHPMIKIAEDRGAGIASSLIRPRPNLPPSRGRKSARSKRKPKK

SEQ ID NO: 279 - DNA, 1014 bp, Unknown
  Obtained from an environmental sample
atgggcattacccatcccaaatacaaagtcgctgcagtccaggccgcgccggtctggctggacctggatgccacggtggacaagtgcatccgcctgatccaggaggccgctgacaagggctgcaagctgatcgcgtttccggagacgttcattcccggctatccctggcacatctggatgggtgcgccggcctgggccatcggccggggctttgtgcagcggtatttcgacaactccctgtcctatgacagcccgcaggccgaaaagctgcgccaggccgtcaaggccgcaggcatcaccgcgtcgctgggactgtcggagcgctcgggcggcagtctctacatcgcgcagtggctcattggccccgacggcgaaacgatctcgcagcggcgtaagctgcggcccacgcattccgaacgcaccgtcttcggcgacggcgatgggagcgacctcaaggtgcacgacacgccgctgggccgtgtgggtgagctggcgtgctgggagaacatcctgtcgctgaacaagtacgccatgttctcgcagcacgagcaggtgcacattgcagcctggcctagcttctccacctacgagccctttgcacatgccctgggctgggaagtgaacaacgcagtcagcaaggtgtacgcagtggaaggcgggtgtttcgtggtggcaccctgcgccatcatttccaaggagatggtcgatgaactgtgcgacaccccggacaagcacaccctgacccatgtgggaggcggccacgcggtgatctacgggccggatggcgcccccctggcggacaagctgcctgaagacgccgagggcctgctgatcgcggagatcgacctcgggatgattggcgtggccaagaacgccatggacccggtagggcactactcgcgccccgacgtgcaccgcctgcttctcaaccgcaagaaggcagcgcaggtggagcactttgcgctgccggtggacgccatcgattccgagccccaagccaccacggcgcactga

SEQ ID NO: 280 - protein, 337 aa, Unknown
  Obtained from an environmental sample
MGITHPKYKVAAVQAAPVWLDLDATVDKCIRLIQEAADKGCKLIAFPETFIPGYPWHIWMGAPAWAIGRGFVQRYFDNSLSYDSPQAEKLRQAVKAAGITASLGLSERSGGSLYIAQWLIGPDGETISQRRKLRPTHSERTVFGDGDGSDLKVHDTPLGRVGELACWENILSLNKYAMFSQHEQVHIAAWPSFSTYEPFAHALGWEVNNAVSKVYAVEGGCFVVAPCAIISKEMVDELCDTPDKHTLTHVGGGHAVIYGPDGAPLADKLPEDAEGLLIAEIDLGMIGVAKNAMDPVGHYSRPDVHRLLLNRKKAAQVEHFALPVDAIDSEPQATTAH

SEQ ID NO: 281 - DNA, 936 bp, Unknown
  Obtained from an environmental sample
atgtccaagatcgccgtcgtccaagagcctccggtgctgctcgatcgcgccgccaccctcgagcgcgccgtctcggccatcgagcgggcggccgacgtgggggcgcacctcgtcgtgttccccgagacgtacgtcccggggtaccccgactgggtctggcggacgcgccccgacgacttcaagctcgcgggcgcgctgcacgagcgcctcctcgcgaacgcggtcgacctcgaaaaggaccagctcgcgccgctccgcgaggccgcgcgccggcgaggcgtcaccatcgcgtgcggcgtgaacgagcgcgaggggagccacggccgcgcgaccctctacaacaccgtcgtcgtcgtcggacccgacggcgcgatcctcaaccgccaccgcaagctcgtccccacgaaccccgagcgcatggtctggggcccgggtgacgcgagcgggctgcgcgtcgtcgacacgccggccggccgcgtgggggcgctcatctgctgggagaactacatgccgctcgcgcgcttcgcgctctacgcgcagggcgtcgaggtctacctcgcgccgacgtgggatcacggcgacacttggctcgcctccatgcggcacatcgcgcgcgaggcgcgcgcctgggtcgtctcgggggccatctgcatgcaggcgaaggacgtccccgccgacttcccgcagcgcgcggcgatctaccccgacgaggaggagtggctcaaccccggcgatgccgtcgtcgtcgatcccaccggcgccgtcgccgccggcccgctgcaccgcgagcgcggcatcctctacgccgagtgcgatcccgcgcgggcgtcgctcgcccgccgcacgctcgacgtctccgggcactacggacggcccgacgtctttcacctgcagatcgaccgcacaccgcgcgtgccggcgtcgttccgggactga

SEQ ID NO: 282 - protein, 311 aa, Unknown
  Obtained from an environmental sample
MSKIAVVQEPPVLLDRAATLERAVSAIERAADVGAHLVVFPETYVPGYPDWVWRTRPDDFKLAGALHERLLANAVDLEKDQLAPLREAARRRGVTIACGVNEREGSHGRATLYNTVVVVGPDGAILNRHRKLVPTNPERMVWGPGDASGLRVVDTPAGRVGALICWENYMPLARFALYAQGVEVYLAPTWDHGDTWLASMRHIAREARAWVVSGAICMQAKDVPADFPQRAAIYPDEEEWLNPGDAVVVDPTGAVAAGPLHRERGILYAECDPARASLARRTLDVSGHYGRPDVFHLQIDRTPRVPASFRD

SEQ ID NO: 283 - DNA, 1017 bp, Unknown
  Obtained from an environmental sample
atgggcatcgaacatccgaagtacaaggtcgcggtggtgcaggcggcaccggcctggctcgatctcgacgcgtcgatcgacaagaccatcgggctgatcgaggaggccgcccaaaaaggcgccaagctgattgcattccccgaggccttcatccccggttacccctggcacatctggatggactcgccggcctgggcgatcggccgcggtttcgtgcagcgctattttgacaattcgctcgcctatgacagcccgcaggccgagaaactgcgcgcggcggttcgcaaggcaaagctcacggccgtgatcgggctgtccgagcgcgacggcggcagtctttacctcgcgcaatggctgatcgggcccgacggtgagaccatcgccaagcgccgcaagctgcggccgacacatgcggagcgcacggtatacggcgagggcgacggcagcgacctcgcggttcacaaccgtccggacattggccgccttggcgcgctctgctgctgggagcatctccagccgctgtcgaaatacgcgatgtacgcgcagaacgagcaggtgcatgtcgcggcctggccgagcttttcgctgtacgatcccttcgcggtggcgctcggcgccgaagtgaacaacgcggcctcgcgcgtctatgcggtcgaaggctcctgcttcgtgctggcgccgtgcgcgacggtctcgcaggccatgatcgacgaactctgcgaccggccggacaagcacgcgctgttgcatgtcggcggcggttttgccgcgatctacggtcctgacggcagccagatcggcgacaaactcgctcccgaccaggaagggttgctgatcgcggagatcgatctcggcgccatcggcgtcgccaagaatgcggcggatcccgccgggcattattcgcggcctgacgtgacgcgactgttgctcaacaagaagccgtacaagcgcgtcgagcagttttcgccgccggccgaggcgctcgagccgacggatatcgcagcagcagcaagctaa

SEQ ID NO: 284 - protein, 338 aa, Unknown
  Obtained from an environmental sample
MGIEHPKYKVAVVQAAPAWLDLDASIDKTIGLIEEAAQKGAKLIAFPEAFIPGYPWHIWMDSPAWAIGRGFVQRYFDNSLAYDSPQAEKLRAAVRKAKLTAVIGLSERDGGSLYLAQWLIGPDGETIAKRRKLRPTHAERTVYGEGDGSDLAVHNRPDIGRLGALCCWEHLQPLSKYAMYAQNEQVHVAAWPSFSLYDPFAVALGAEVNNAASRVYAVEGSCFVLAPCATVSQAMIDELCDRPDKHALLHVGGGFAAIYGPDGSQIGDKLAPDQEGLLIAEIDLGAIGVAKNAADPAGHYSRPDVTRLLLNKKPYKRVEQFSPPAEALEPTDIAAAAS

SEQ ID NO: 285 - DNA, 918 bp, Unknown
  Obtained from an environmental sample
atgaatactaatctagtaaaggtcgcggcggctcaagttgctccccattttctcaatttgagcaatacggtggaaaaaacctgcaacttaatttctgaagcaggcaaaaatggagcaaagctaatcgtatttccagaagccttcatctctggttatcccgattgggtctggcttattcccaatgcgaattctgcaatgctggatgatttataccaggaattggttgagaacgcagtaacgatccctgatacaacaacacataaactatgtcaggctgcaaaagatgcaggggtatatgttgcggtaggtatacatgagagaaattcagaagcaagtggcttcacgcttttcaatacgcttctatacatcaacgatcaaggcgtaatcatcggaaaacaccgaaaattaatccctacagggggcgaacggctggtctgggggcagggtaatggggatacactttctgcattcgatacagacttcggcaaattaggaggattgctttgttgggaaaattatatgccactcgcgcgtcaagctatgtattccgttggaactgaagtatatgtagccccaacctgggactccagcgagaattggttgttaagcatgcgccatattgcccgagagggcggtatgtttgtaattagtgtttgccaggctctccgaaaagacgacatccctgatcagtatgaatttaagaaactctatcctgataattcagaatggatcaatagcggtaacagttgcatcatcaacccgcgcggtgagattattgctggaccaatctcaaaccaacaagaaatactttatgcagatttagacctgagtttaattgcaaaatctaaacgtatgttcgatgttactgggcattattcccggccggatgtgtttagctatgaaatcaacaaaagctag

SEQ ID NO: 286 - protein, 305 aa, Unknown
  Obtained from an environmental sample
MNTNLVKVAAAQVAPHFLNLSNTVEKTCNLISEAGKNGAKLIVFPEAFISGYPDWVWLIPNANSAMLDDLYQELVENAVTIPDTTTHKLCQAAKDAGVYVAVGIHERNSEASGFTLFNTLLYINDQGVIIGKHRKLIPTGGERLVWGQGNGDTLSAFDTDFGKLGGLLCWENYMPLARQAMYSVGTEVYVAPTWDSSENWLLSMRHIAREGGMFVISVCQALRKDDIPDQYEFKKLYPDNSEWINSGNSCIINPRGEIIAGPISNQQEILYADLDLSLIAKSKRMFDVTGHYSRPDVFSYEINKS

SEQ ID NO: 287 - DNA, 936 bp, Unknown
  Obtained from an environmental sample
gtgatcaaggtagcaatcgcccaggtggcaccggtggttctggacaaggcgcgcaccattgagaaagcggtaggaattattcgcgctgccgcgcaagagggcattgagctcctggttttcccggagacgtttatcccgacctatccagcctgggtatggcgcttgcgtccgggtactgattacggcctgagcgaggaactgcacgcgctcctgctggataattcggtagatatggagagcaaggacctggagccattgcaagctgttgctgcagagaccagcatgaccgtggtaataggtatgaacgagcgagacggccgattcagccggggtacaatctacaatgccctggttgtgatcggtccaggtggcacgatcctgaacaggcaccgcaagcttatgcccaccaaccccgagcgtatggtttggggtatgggcgatgccagcgggctgaaggtagtggaaatgtcttacgggcgcctgggtgggctgatttgctgggagaatttcatgcctctcgcgcgctatggcttgtatgcccagggtgtggagatttacgtggcgcccacctatgaccagggcgacggctgggtcggcagcatgcagcatatagcccgggagggtcgttgctgggtactctcggccgggacccttttgcgtggcagtgattttctgccggattttccgggcaagaccgagttatatcccgatgaccaggagtgggtgaatccgggtggctcggtgatcgtggcaccggggggagagattgtggccggccccatgtatcgcgacgaaggtctgctggtctgcgagttggatgcgacgcttagtgtccgcggcaagcgctcgctggatgtggccggccattactcccggccggatttgtttgaactggaaatagatggcgacccgctggaacccatagagtgggattga

SEQ ID NO: 288 - protein, 311 aa, Unknown
  Obtained from an environmental sample
VIKVAIAQVAPVVLDKARTIEKAVGIIRAAAQEGIELLVFPETFIPTYPAWVWRLRPGTDYGLSEELHALLLDNSVDMESKDLEPLQAVAAETSMTVVIGMNERDGRFSRGTIYNALVVIGPGGTILNRHRKLMPTNPERMVWGMGDASGLKVVEMSYGRLGGLICWENFMPLARYGLYAQGVEIYVAPTYDQGDGWVGSMQHIAREGRCWVLSAGTLLRGSDFLPDFPGKTELYPDDQEWVNPGGSVIVAPGGEIVAGPMYRDEGLLVCELDATLSVRGKRSLDVAGHYSRPDLFELEIDGDPLEPIEWD

SEQ ID NO: 289 - DNA, 921 bp, Unknown
  Obtained from an environmental sample
atggtgacggtggccgccgtacaggcaacgccggtgttcctcgaccgcgaggcgacctcggacaaggtctgcgccttggtcaaggaggcggccggccacggggcagaactgatcgtcttccccgagtccttcgtccctgcctatccggactgggtgtggcgcacccctgcctggagtgacaccgagttcgtgaagcgcttctacgcgaacgcggtgaccgtccccggcgcgaccctcgagcgcatcggcgcagcggcggcggaggcggaggcgtacgtcgtgatcggcgtgaccgagatcgacggcggaactctctacaacacccttctctacctgggcccggacggacagctgttgcaacggcatcgcaagctcatgcccaccggtggggagcggaccgtgtggggaatgggagacggctctgagctcgacgtcgtgagcacgccgttcggcgtcgtcggtgggttgttgtgctgggagaactacatgccgctcgcccgggcggcgatctacgcccagcactgtgacatctacctggctccgacatgggacaacagcgacacgtgggtagccacgttgcgtcacatcgccaaggaggggcggcagttcgtcatcggcgtcgccccgctgctgcgcggctccgacgtaccggaggacctccgcggcacgctctacgggctgtcggacgactggatgtcgcgcggctacaccaccatcgtcgcaccaagcggcgaggtgatcgccggcccggtcctggagcgtgaggagatcctcttcgcggacctcgacctggccgacgtgcaggagcagagaaggatgttcgaccctgtcggccactactcacgacccgacgtcttcacgctccacgtcgacgcacgaccgaagagcccggtcgtcttcgagagggatgcaccgacctga

SEQ ID NO: 290 - protein, 306 aa, Unknown
  Obtained from an environmental sample
MVTVAAVQATPVFLDREATSDKVCALVKEAAGHGAELIVFPESFVPAYPDWVWRTPAWSDTEFVKRFYANAVTVPGATLERIGAAAAEAEAYVVIGVTEIDGGTLYNTLLYLGPDGQLLQRHRKLMPTGGERTVWGMGDGSELDVVSTPFGVVGGLLCWENYMPLARAAIYAQHCDIYLAPTWDNSDTWVATLRHIAKEGRQFVIGVAPLLRGSDVPEDLRGTLYGLSDDWMSRGYTTIVAPSGEVIAGPVLEREEILFADLDLADVQEQRRMFDPVGHYSRPDVFTLHVDARPKSPVVFERDAPT

SEQ ID NO: 291 - DNA, 1002 bp, Unknown
  Obtained from an environmental sample
atgatgaaaacaactgttaccgttgcctgcgttcaggccgcccccgtatttatggatttagaaggcaccatagataaaacgatcaccctcatctctgaagccgcacagaaaggcgcggagctcatcgcttttccggagacctggatacccggttacccgtggttcttatggctgaactcgcccgcgacaaatatgcccctggtttatcaatatcatcagaactctctggtgctggacagtgcccaggcgaagcgaattgcggatgctgcacagcagaataacatcactgtcgttctgggattcagcgagcgcgatcatggaagcctctatatctcacagtggctgattggcagcgacggggaaactattggcatccggcgcaagctcaaggccacacacgtggagcgtacgctgttcggcgaaagcgacggctcctccctgaccacctgggagacacctctgggtaacgtcggggccctctgctgctgggagcacctgcagccgctgtctcgctatgcgatgtattcccagcatgaagagatccatatcgctgcgtggcccagcttcagtctttacaccagcgcaactgccgcgctcggacctgacgtcaacacggcggcttcacgcctctatgccgcggaggggcagtgcttcgtgttagccccatgtgccgtggtttctgatgagatgattgatttactctgtcctgatgatgaccggagagcgttactcagtgccggagggggacatgcccgtatttacggacctgatggaagagaactcgtcacccctctcggggaaaatgaggaaggactgcttatcgctgagctcgactctgctgcgatcacctttgccaaactggcggcagatcccgtaggccactattcccgccctgacgtgacccgccttctttttaatccttcagccaacaagactgttattaaacggcattcgcctcctgagttaattgccgaacaggctccggaagaagaggaggagtag

SEQ ID NO: 292 - protein, 333 aa, Unknown
  Obtained from an environmental sample
MMKTTVTVACVQAAPVFMDLEGTIDKTITLISEAAQKGAELIAFPETWIPGYPWFLWLNSPATNMPLVYQYHQNSLVLDSAQAKRIADAAQQNNITVVLGFSERDHGSLYISQWLIGSDGETIGIRRKLKATHVERTLFGESDGSSLTTWETPLGNVGALCCWEHLQPLSRYAMYSQHEEIHIAAWPSFSLYTSATAALGPDVNTAASRLYAAEGQCFVLAPCAVVSDEMIDLLCPDDDRRALLSAGGGHARIYGPDGRELVTPLGENEEGLLIAELDSAAITFAKLAADPVGHYSRPDVTRLLFNPSANKTVIKRHSPPELIAEQAPEEEEE

SEQ ID NO: 293 - DNA, 1008 bp, Unknown; identical to SEQ ID NO: 39
  Obtained from an environmental sample

SEQ ID NO: 294 - protein, 335 aa, Unknown; identical to SEQ ID NO: 40
  Obtained from an environmental sample

SEQ ID NO: 295 - DNA, 1134 bp, Unknown
  Obtained from an environmental sample
atggccgcaaaagtacttggaggacgtgacacagtaaaagtagcagttgttcaaacaccatcagtctttatggacaagaaagcctgtctcgaacttgcctgcgataagattatcgaagccggcaaagagggcgcggagcttgttgtttttcctgaaacctggattccgacatatccttattggaccatgggatgggataccatcgcccatggcttccatgatgtgatggcggacctgcaggacaattccgtggtcgtcgggagcgaagacaccgacatattgggcaaagccgcccgggaagctggcgcctacgtcgtcatgggctgtaatgagctcgatgaccgggtcggcagcaggaccttgttcaactcgctggtctatatggacaaatatggcggcgtgctcggccgtcaccgtaaattaatcccgtcctttatcgaacgcatctggtggggcaatggggacagccgcgatctcaaagtttacgacacggaaattgggcgcatcggcggtcaaatctgctgggaaaatcacattgtgaacatcaccgcatggtacattgcccaaggcgtggatattcatgtctcggtttggccgggaatgtggaactgtggcgcagaagaaggagaatccttcatatacgccggtcacgacatcaacaaatgtgacctcatccctgctacacgcggacgggcatttacgggtcagtgttatgtcctctcagccaacaacctactgcggatggaagacattcctgacgatttcccgttccgggataccatgaactatggcggtccgggccaggaggattttgtcggatgggcttgcggtggcagccatattgttgcgccaacgtctgaatttatggtgccgccgacgtttgatatagacaccatcatctatgcagaacttcaggcgaaatacatcaaagtggtgaagtcggtcttcgattccctcggccactacgcgcggtgggacctcgtcaacttgaccacgccgccaccgccgtatgaacctgaaaccgacgcaccagctctcacggccgatatccgtgatcgggtcatcgagagtgtggctaaagagttcaagctcgaaccagaaaaagtggctgaagttgtgcgcaatgccgcctag

SEQ ID NO: 296 - protein, 377 aa, Unknown
  Obtained from an environmental sample
MAAKVLGGRDTVKVAVVQTPSVFMDKKACLELACDKIIEAGKEGAELVVFPETWIPTYPYWTMGWDTIAHGFHDVMADLQDNSVVVGSEDTDILGKAAREAGAYVVMGCNELDDRVGSRTLFNSLVYMDKYGGVLGRHRKLIPSFIERIWWGNGDSRDLKVYDTEIGRIGGQICWENHIVNITAWYIAQGVDIHVSVWPGMWNCGAEEGESFIYAGHDINKCDLIPATRGRAFTGQCYVLSANNLLRMEDIPDDFPFRDTMNYGGPGQEDFVGWACGGSHIVAPTSEFMVPPTFDIDTIIYAELQAKYIKVVKSVFDSLGHYARWDLVNLTTPPPPYEPETDAPALTADIRDRVIESVAKEFKLEPEKVAEVVRNAA

SEQ ID NO: 297 - DNA, 1059 bp, Unknown
  Obtained from an environmental sample
atgacacgttttcgggacgtcacggtggcggcggttcaggccgcacccgtctatttcgatcgggaggcctccacagataaggcgtgccaattgattcacgaagcggcgaagaaaggcgcagccctcgcggcgttcggcgaaacgtggttgccgggatatccgttctttgcatgggggttcgcgcacaaccggagcctgttctggaatgcggccgccgagtacatcgccaatgctgtggagattccgagtccaacgacggaccgcctctgcgccgcagcgaagatcgccgggattgacgtggtaatcggcgtcgtagaactggatggacgaacgcgagcgtcggtttacagcacactgctgttcatcgggagagagggggcgatcctggggcgccaccgcaaattgaagccaacccacatggagcgaacggtgtggggtgaaggggacgctcacgggctccgcgttcacgagcgtccgtacggccgcctcagcgggctgaattgctgggaacacaacatgatgctgcccggctatgtgcttgccgcgcagggcacgcagtttcacgtcgcgacatggcctgggaaagagaggctcacagttccgccgaacgaggcggcttatacgcgccagcttctcctctctcgcgcctatgcatcccaggcgggcgcgtacgtgatcagcgtcgcggggctgctcggacccgactcgatgccggagcgttatcgcgaactgggacagtcctatgagttgaccggcgacagcgtcatcatcgatccgcgcggcgaggtcatcgcggggcccgcgaagggcgagaccatcctgctcgcgcaatgcagccaggaagccctcttcgccgcaaagtccgccattgacgtcggcggtcattactcgcgcccggatatttttcagctgcgtgtcaacgatcagctacagcatcaggtccggagactcgaggcgactctcacgcccccagtcgccgtagttgtcgggcctgagggtagctcacatgagcaggagacggccttcgggccatccagcctcctggccacgacaagctag

SEQ ID NO: 298 - protein, 352 aa, Unknown
  Obtained from an environmental sample
MTRFRDVTVAAVQAAPVYFDREASTDKACQLIHEAAKKGAALAAFGETWLPGYPFFAWGFAHNRSLFWNAAAEYIANAVEIPSPTTDRLCAAAKIAGIDVVIGVVELDGRTRASVYSTLLFIGREGAILGRHRKLKPTHMERTVWGEGDAHGLRVHERPYGRLSGLNCWEHNMMLPGYVLAAQGTQFHVATWPGKERLTVPPNEAAYTRQLLLSRAYASQAGAYVISVAGLLGPDSMPERYRELGQSYELTGDSVIIDPRGEVIAGPAKGETILLAQCSQEALFAAKSAIDVGGHYSRPDIFQLRVNDQLQHQVRRLEATLTPPVAVVVGPEGSSHEQETAFGPSSLLATTS

SEQ ID NO: 299 - DNA, 987 bp, Unknown
  Obtained from an environmental sample
atgactgttgttaaggccgccgcagtgcagatcagcccggtgctctacagccgtgcaggaaccgtcgagaaggtcgtgaagaagatcgacgagctgggccagaagggtgtcgagtttgccgtcttccctgaaaccgttgtcccctactacccctacttctccttcgtgcagcccccctacaaactggccacggagcacctgcgcctgcttgaggagtcggtgaccgtgccctctgccgagacggacgccatcggcgacgccgcccgcaaggccaacatggtcgtctcgatcggtgtcaacgaacgtgatggcggcaccatttacaacacccaactcctgttcgacgccgacggaaccctgatccagcgccgccgcaagatcacgccgacctaccacgagcggatgatctggggacagggagacggatcaggcttgcgcgcggtcgacagcgtcgtcggccgcatcggccagctcgcctgctgggagcactaccagccgctggcccgttacgctctcatcgccgacggcgagcagatccacgccgcgatgtaccccggcgccttcgggggcgatctgttcgcagagcagatcgaagtcaatgtccgtcagcacgctctggaatcggccagtttcgtcgtcagcgccaccgcctggctcgacgccgaccagcaggcccagattgcgaaggacaccggcggccccgtacaggcgatctccggcggcttcttcacagccatcatcgaccccgacggccgcatcatcggcgaaccgatcacctccggcgaaggcgaagtcatcgctgacctcgactttgcgctcatcgaccgccgcaagcgcctgatggacgccagcggccactacagccgccccgaactgctcagcctgcagatcgaccggacgccggcacccgccgtccacgatcgcaatcgccaggggtcctcaagcgctccggcaactgaaaagggccgctcagccgaggccaagtga

SEQ ID NO: 300 - protein, 328 aa, Unknown
  Obtained from an environmental sample
MTVVKAAAVQISPVLYSRAGTVEKVVKKIDELGQKGVEFAVFPETVVPYYPYFSFVQPPYKLATEHLRLLEESVTVPSAETDAIGDAARKANMVVSIGVNERDGGTIYNTQLLFDADGTLIQRRRKITPTYHERMIWGQGDGSGLRAVDSVVGRIGQLACWEHYQPLARYALIADGEQIHAAMYPGAFGGDLFAEQIEVNVRQHALESASFVVSATAWLDADQQAQIAKDTGGPVQAISGGFFTAIIDPDGRIIGEPITSGEGEVIADLDFALIDRRKRLMDASGHYSRPELLSLQIDRTPAPAVHDRNRQGSSSAPATEKGRSAEAK

SEQ ID NO: 301 - DNA, 1032 bp, Unknown
  Obtained from an environmental sample
atgaccacgcccgcgccgttcaccgccgccgtcgtccaggcgtcgcccgtgttcctcgaccgcgatgccacggtcgataaggcgtgcgccctgatcaccgcggccggagcgcgcggcgcgaagctcgtcgtgctgcccgagaccttcgtgcccgcataccccgcgtgggtctggtacctgccgctcacgcgtcggcccgacgtcgcgaagctctaccgcgcgctcgtcgagaacgcgatcgacgtgccgggtccggaaaccgagcgcctcgggcgcgcggcgcgtgacgcgggcgcgtgggtggcgatcggtgtcaacgagcgcaacgcgaaggcgagccgcacgtcgctctacaacaccgtgctcctgttcgacgaccagggcacgctggtcgagtcgcggcgcaagctgatgccgaccggcggcgagcgcctggtgtggacgccgggcgagccggtgccgttgcgggttcacgacacgccgctcggccgcgtcggcgcgctgatctgctgggagaactacatgccgctcgcgcgcttcgcgctctacgagcagggcgtccagatctatctcgcgccgacctgggactacagcgaggcgtggctcgcgtccatgcggcacgtcgcgcgtgaaggtcgcacgtgggtgatcgggtgcagccaggcggtgcggcgtgacgagatcccggaccacctgccgttcaaggacgcgatccccgagagcctcgagtggatcaacgccgggaacagcatcgtcgtcgatccggacggcgcggtggtcgcgggaccgctggcgcgggcgcacgacacgctctacgtcgagatcgatccgggccgcgccgccggctcccgatggatcttcgacgccgccggtcactatcaccgtcccgacctgttccatttcgcgatgcgcgcgccggtggcgccagagaccgcgccggttgtgcggaagcgcggccggcggctagcctcggccccggcgcggaagccacggaaacggccggcgcgtcccacccgaaggaggactcgatga

SEQ ID NO: 302 - protein, 335 aa, Unknown
  Obtained from an environmental sample
MTTPAPFTAAVVQASPVFLDRDATVDKACALITAAGARGAKLVVLPETFVPAYPAWVWYLPLTRRPDVAKLYRALVENAIDVPGPETERLGRAARDAGAWVAIGVNERNAKASRTSLYNTVLLFDDQGTLVESRRKLMPTGGERLVWTPGEPVPLRVHDTPLGRVGALICWENYMPLARFALYEQGVQIYLAPTWDYSEAWLASMRHVAREGRTWVIGCSQAVRRDEIPDHLPFKDAIPESLEWINAGNSIVVDPDGAVVAGPLARAHDTLYVEIDPGRAAGSRWIFDAAGHYHRPDLFHFAMRAPVAPETAPVVRKRGRRLASAPARKPRKRPA

SEQ ID NO: 303 - DNA, 1011 bp, Unknown
  Obtained from an environmental sample
atgggcatcgttcaccccaagtacaaagtcgctgtcgttcaggctgcccctgtatggctagacctggaggccactgttgataaatgcattcagttgattgaagaagcagccagcaagggctgcaagctcatcgccttccctgagaccttcattcccggatacccttggtatatctggatgggaacgcctgcctggactattcagcgcggctttgtacagcgctattttgataattctctgtcttatgacagtccgcaagcggagaagctaaggcaggcagtcaaaaaggctgagatcacggccgtactaggtctttctgagcgcagcggcggtagcttgtacattgcacaatggaccattggccctgacggagaaaccatacacaaacgcagaaaagtgcgtccaacgcatggtgagcgtacggtatttggcgacggtgacggtagtgatcttgcggtgcacgatacccccctggggcggctgggcgcgcttgcgtgctgggagaacatactgtcactgaacaagtatgcgatgtattcacagaatgagcaggtgcacgtagccgcttggcctagcttctcggtctacgagcctttcgcccatgcattgggttgggaggtcaataacgcagtcagcaaggtttacgcggtagaaggcggctgttttgtattggcgccttgcgcagtggtctccgaggaaatgatcgaagcactgtgcgatacacccgataagcaccaactggctcatgcgggtggagggcatgctgtcatttacggaccagatggcagtcctctggcagataagttacccgaaggagaggaggggctattaattgcagaaattgatctcggtctcatcagcttggcgaaaaatgccatggacccggtggggcattactctcgacctgacgtacatcgcttgctattgaatcgcaatccagcaaagcgggttgaggaattttctctgcccattgatttggcagagacaactccgccaatattaggcacgtag

SEQ ID NO: 304 - protein, 336 aa, Unknown
  Obtained from an environmental sample
MGIVHPKYKVAVVQAAPVWLDLEATVDKCIQLIEEAASKGCKLIAFPETFIPGYPWYIWMGTPAWTIQRGFVQRYFDNSLSYDSPQAEKLRQAVKKAEITAVLGLSERSGGSLYIAQWTIGPDGETIHKRRKVRPTHGERTVFGDGDGSDLAVHDTPLGRLGALACWENILSLNKYAMYSQNEQVHVAAWPSFSVYEPFAHALGWEVNNAVSKVYAVEGGCFVLAPCAVVSEEMIEALCDTPDKHQLAHAGGGHAVIYGPDGSPLADKLPEGEEGLLIAEIDLGLISLAKNAMDPVGHYSRPDVHRLLLNRNPAKRVEEFSLPIDLAETTPPILGT

SEQ ID NO: 305 - DNA, 1068 bp, Unknown
  Obtained from an environmental sample
atgacgatgcaacatcccaagtttcgcgctgctgccgtgcaggcggcaccggtcttccttgaccttgatgcgtcgatagataaagccatcgacctgatcgcgcaagccgccaaaggcggcgcgcaattgattgcctttccggaaacctggctgcccggctacccctttttcatctggctcgattcgccggcctggggcatgcaattcatccagcgctaccatgacaattccctggtctacggcacaccgcaggccgagcgcatcgcgcaggctgcgaaaaagcatcgcatcatggtcgtcatggggcacagcgagcgggatcatggaagtctgtacatcgctcagtggatcatcggtgccgatggggaaacggttgcgacacgtcgtaagctcaaaccgactcatgccgagcgcaccttgtttggggaaggcgatggcagtgacctgagcgtgttcgatacaccgctgggaagggttggcgcactatgctgctgggagcacctccagcccctgtcgaaatacgcgctatacgcacagaatgagcaggtccacattgcttcctggccaagcttttccctgtatcgcgggggcgcctacgcgctcggcgccgaagtgaacaatgcggccagccagatttatgctgtcgaaggccagtgttttgtgatcgcgccgtgcggggtcgtcacgaaagaaatgctggacgtgctgtgcaccgacgaaatgaaaaagcagttgttggttgaaggcggcgggttcgcgcgaatttacgcgcccgatggacagatgatgcacgcgccgctggcggaaaacgaagagggcctggtgtatgccgatctcgacctgggcatgatctcgctggccaaagtagtcgccgacccggccgggcattatgcgcggcccgacgtaacccggttactgctggacaagactccgggagaccgcgtcatgctggcgagccgtcgcggcaaggaggtcagccgcgctggtaacgacgagccgcaagtgctggtctcgcgcaacgacacgctgacctcgccgaagccagcgtcttcgcgcaaagcaagctga

SEQ ID NO: 306 - protein, 355 aa, Unknown
  Obtained from an environmental sample
MTMQHPKFRAAAVQAAPVFLDLDASIDKAIDLIAQAAKGGAQLIAFPETWLPGYPFFIWLDSPAWGMQFIQRYHDNSLVYGTPQAERIAQAAKKHRIMVVMGHSERDHGSLYIAQWIIGADGETVATRRKLKPTHAERTLFGEGDGSDLSVFDTPLGRVGALCCWEHLQPLSKYALYAQNEQVHIASWPSFSLYRGGAYALGAEVNNAASQIYAVEGQCFVIAPCGVVTKEMLDVLCTDEMKKQLLVEGGGFARIYAPDGQMMHAPLAENEEGLVYADLDLGMISLAKVVADPAGHYARPDVTRLLLDKTPGDRVMLASRRGKEVSRAGNDEPQVLVSRNDTLTSPKPASSRKAS

SEQ ID NO: 307 - DNA, 942 bp, Unknown
  Obtained from an environmental sample
atggctgaaccggaatcctttatcgtcgctgctgtacaggctacaccgatctttcttgaccgccaggcaacccttgagaaagcgtgcgacctgattgccgaagctggcagcaatggcgcaaaactcgttctttttcccgaagcctttatccccacctatcctgattggatatgggcggtgacaggctcacaatctgcgctgctcgacgaactttatgtggaactactggaaaactccgtgaccatccccgacgcgaccactgagcaactttgtgaagcagcacgtaacgccggtctctacgtcgtcatgggagtgaatgagcgcaacgccgaggcgagcaacgccacactctataacaccctgctctatattgacgatcagggcaaaattctcggcaagcatcgcaaattggtcccgaccgccctggagcgaatcgtctggggctatggcgatggcagcacgcttgacgcctttgaaacgccgctgggcaagattggcgggctgatctgttgggaaaattacatgccactggcgcgccaaacactttatgcctggggggtgcaaatttacttggccgcaacgtgggatcgcggcgaagtttggcaggcgaccatgcgccatattgccagggaaggcggcgtctatgtagtcgcctcctgtattccatttcacatcaaagacattcctgaccacatgcctgaaatccgcaatctctatgcaccggggacagactggatcaacgtcggccaaagctgcatcatcaaccccagcggcgactatattgcaggccctgtcgagtgtcgcgaggagattctttatgccgaggtaaatctgcgccagagtgcggcggcaaaacgtatgttggatgtggcgggccattatggacgccctgatgtctttcacctcaccgtcaaccgcacgcccaatccgcatattcgataa

SEQ ID NO: 308 - protein, 313 aa, Unknown
  Obtained from an environmental sample
MAEPESFIVAAVQATPIFLDRQATLEKACDLIAEAGSNGAKLVLFPEAFIPTYPDWIWAVTGSQSALLDELYVELLENSVTIPDATTEQLCEAARNAGLYVVMGVNERNAEASNATLYNTLLYIDDQGKILGKHRKLVPTALERIVWGYGDGSTLDAFETPLGKIGGLICWENYMPLARQTLYAWGVQIYLAATWDRGEVWQATMRHIAREGGVYVVASCIPFHIKDIPDHMPEIRNLYAPGTDWINVGQSCIINPSGDYIAGPVECREEILYAEVNLRQSAAAKRMLDVAGHYGRPDVFHLTVNRTPNPHIR

SEQ ID NO: 309 - DNA, 951 bp, Unknown
  Obtained from an environmental sample
ttgaccgactgtctcaaaatagccgccgcccaaatcactccggtcttcctcgaccgcgttgcgaccacgaagaaggtcgtcgaaaccatcgaaaaagcggccgccggcggtgcgcggctggtcgcattcggcgaagcgctgttgcccgcctatccattgtggctgacgcgcaccgacgccgcgcggttcaattccgacgtgcaaaaaaacttgcacgcgatctatctcaagcaatccgtctcgatagcaggcggtcacctatctccgatttgcaaaatcgcaagcgaacgcaagattgccgtcatcctcggcatcgccgagcgcgcgaccgaccggggcgaccacaccatttactgctcgtgcgtgttcatcgatgccgacggccgaatcgcgtcggtccatcgcaagctgatgccgacatacgaagaacgcctcagttggggattcggcgacggtgcgggactcgtcacgcatccggtcgggccgttcacggtgggcgcgttgaactgctgggaaaactggatgcccctcgcgcgcaccgcgctgtatgccggcggagaagatttgcacgttgcgatctggcccggcggatcggtgctcacggaagacatcacgcgcttcatcgcacgcgagtcgcgctcgttcgtcctgtccgtcagcggcatcattcgcgaaagcgacatccccagcggggtcccctatcgcgatgaaatgtgtgcgaaaggcgaaaccatctacaacggcggaagctgcatcgccggacccgacggtcagtggatcatcgcgcccgtaaccgaccgtgaagagttgatcttcgcggagatcgaccacgaacacgtccgccgcgagcggcagaatttcgacccggccgggcattacgcgcggcccgatgtgttgcaaataaccgttgatcgtcgacgacaaacagcggcgaattttattgatgactaa

SEQ ID NO: 310 - protein, 316 aa, Unknown
  Obtained from an environmental sample
LTDCLKIAAAQITPVFLDRVATTKKVVETIEKAAAGGARLVAFGEALLPAYPLWLTRTDAARFNSDVQKNLHAIYLKQSVSIAGGHLSPICKIASERKIAVILGIAERATDRGDHTIYCSCVFIDADGRIASVHRKLMPTYEERLSWGFGDGAGLVTHPVGPFTVGALNCWENWMPLARTALYAGGEDLHVAIWPGGSVLTEDITRFIARESRSFVLSVSGIIRESDIPSGVPYRDEMCAKGETIYNGGSCIAGPDGQWIIAPVTDREELIFAEIDHEHVRRERQNFDPAGHYARPDVLQITVDRRRQTAANFIDD

SEQ ID NO: 311 - DNA, 1011 bp, Unknown
  Obtained from an environmental sample
atgtcagaaaagcgaataatcagagcagctgcagttcagatcacacctgaatttgactcagcagatggaacagttaagaaggtatgcaaggtaatcgatgaagcaggcgcaaagggtgtacaaattatagtattccccgaaaccttcattccgtattacccatacttctcattcattacccccccagtttctgctggcgctgagcatttgaagctttatgaaaaaagtgtcgtgatacctggtcctgtcactcaagcgatcgccgagagagctagagtgaatcaaatggtcgtcgtactcggtgtaaacgagagagataacggtagcctctataacactcaactgatcttcgataccaatggtgagttgatgttgaagagaagaaaaatcactcctacatatcatgagcgcatgatctggggacaaggtgatgcttcaggcttaaaagtagttgaaacgagcattgcccgggtaggtgctctagcttgctgggaacattacaacccgctggccagatattctctcatgacacagcatgaagaaattcactgcgcacaattcccaggttctatggttggccaaatatttgccgaccaaatggatgtcactatcagacatcacgcattggaatctggctgtttcgtcattaatgccaccggctggctcacagacgagcaaatccagtccattacagatgacccaaaaatgcagaaagcattacgtggcggctgcaacacagcaatcatttctcccgaaggtgtgcacttaacagagcccttacgtgaaggtgaaggcattttgattgctgacctggacatgtcactcatcacaaaacgaaaaagaatgatggattcagtaggtcattattcaagacctgaactattaagtctggcgatcaatgacaagccagcaacaacaaaattttcaatgactgaggggtgtactcaaactgagcaatttcgaatcgcagaggagttgaaaaatgacgacaagcttagcaccggaaactaa

SEQ ID NO: 312 - protein, 336 aa, Unknown
  Obtained from an environmental sample
MSEKRIIRAAAVQITPEFDSADGTVKKVCKVIDEAGAKGVQIIVFPETFIPYYPYFSFITPPVSAGAEHLKLYEKSVVIPGPVTQAIAERARVNQMVVVLGVNERDNGSLYNTQLIFDTNGELMLKRRKITPTYHERMIWGQGDASGLKVVETSIARVGALACWEHYNPLARYSLMTQHEEIHCAQFPGSMVGQIFADQMDVTIRHHALESGCFVINATGWLTDEQIQSITDDPKMQKALRGGCNTAIISPEGVHLTEPLREGEGILIADLDMSLITKRKRMMDSVGHYSRPELLSLAINDKPATTKFSMTEGCTQTEQFRIAEELKNDDKLSTGN

SEQ ID NO: 313 - DNA, 987 bp, Unknown
  Obtained from an environmental sample
atggcggccgttcaggctgcgccggttccgtttgatgctgaggcttcggtggataaggcctgtcgcttaattcaagaagctgcagccaaaggcgcagatatagttgctttcggtgaggcatggctacccggctacccctattttgcctggttaccccaagtaacaccagagtggtatagtgcggctgccgattatcttgccagctctgttgatatccctggcccgatcaccgataaactttgccaggctgcccgtcgtgcatcggttgaactcatcatgggtgtggtagaacgcagcaagtctcagggaaccacctattgcacgcttctttttattagcaaggatggcgaaataattggcaagcaccgcaagctgaagcccacactcgccgaacgaaccgtctggggtgaaggcgatgccagcggactgagggttcacgatcggcctattgccagaatcagtgggctctcctgctgggagaacaaaatgatgctgccaggttacgcactgatggcgcagggtacgcaggtgcatgtctccgcctggccagggatcccagaggattcacccatggaggtgcctgcacacccccgtcaaaagctgctttcccaagcctttgcactgcaaggcgggtgctatgttatttctccctccattgtccttagggcagaagatgtgcccgagaaacacgccgctctactgatgggagaccaagtgggcggtagctatatcattgacccctgcggaaaagtgatcgccgaggccggtgcgggtgagactatcctgattgccaaaggcaaccttgacctcgtaagggccgccaaaatggccagtgatgtaggggggtcttattcacgcccggatcttttgcagttgatgatcaataaccgaccactcgaacagctgattgagttcagtgctgaaggtgcaggtagggggaatctagtatccaactcacccgaggtgtcagaacaagaaggtgagtaa

SEQ ID NO: 314 - protein, 328 aa, Unknown
  Obtained from an environmental sample
MAAVQAAPVPFDAEASVDKACRLIQEAAAKGADIVAFGEAWLPGYPYFAWLPQVTPEWYSAAADYLASSVDIPGPITDKLCQAARRASVELIMGVVERSKSQGTTYCTLLFISKDGEIIGKHRKLKPTLAERTVWGEGDASGLRVHDRPIARISGLSCWENKMMLPGYALMAQGTQVHVSAWPGIPEDSPMEVPAHPRQKLLSQAFALQGGCYVISPSIVLRAEDVPEKHAALLMGDQVGGSYIIDPCGKVIAEAGAGETILIAKGNLDLVRAAKMASDVGGSYSRPDLLQLMINNRPLEQLIEFSAEGAGRGNLVSNSPEVSEQEGE

SEQ ID NO: 315 - DNA, 960 bp, Unknown
  Obtained from an environmental sample
atgacaatgcttaagaccaaattccgggttgctgcggtgcaggcagcgcctgtattcctggatcgagaggctacgctggagaaagcctgcggactgattgaggaggcgggtcgcaacggggccagcctggtggtctttcctgagtcgttcattccggcctatcccgattgggtctgggctgtgccggcgggtgaagaagctttacttaatgaactgtatgctcaactgctggccaacgccgttgaaattcccagcccggccaccgaacgcttgagccaggcagcgaaaaaggctaaagtccatgtggttatgggcctgaccgaacgcaacagcgaggccagcggcggcagcctctacaataccttgctctatcttgacccacagggccaaattctgggcaaacatcgcaagctggtgcccaccggcggcgagcggctggtttgggcccagggcgacggcagtaccctgcaagtctacgagacccccttgggtaaactcagcggcttgatttgctgggaaaattatatgccgctggcccgctacgcgctctatgcctggggtacgcaaatctatatcgccgccacctgggatcgaggcgagccgtggctttcgacgctgcggcatatcgccaaagagggccgggtgtttgtcatcggctgtggcatggccttgcgtaaggctgatattcccgaccattttgaattcaagcagcgcttttatcaaaatgccggcgagtggatcaatggaggcgacagcgccattgtcaatcctgagggtgaatttattgctggacccctgagcgagcaggaaggtattttgtacgccgagattgatcctggccagatggccggaccaaaatggatgctcgatgtggccgggcactatgctcgcccggatgtctttgaactgaccgtccagaccgtagctcggcccatgattacctctactcagccgcgatag

SEQ ID NO: 316 - protein, 319 aa, Unknown
  Obtained from an environmental sample
MTMLKTKFRVAAVQAAPVFLDREATLEKACGLIEEAGRNGASLVVFPESFIPAYPDWVWAVPAGEEALLNELYAQLLANAVEIPSPATERLSQAAKKAKVHVVMGLTERNSEASGGSLYNTLLYLDPQGQILGKHRKLVPTGGERLVWAQGDGSTLQVYETPLGKLSGLICWENYMPLARYALYAWGTQIYIAATWDRGEPWLSTLRHIAKEGRVFVIGCGMALRKADIPDHFEFKQRFYQNAGEWINGGDSAIVNPEGEFIAGPLSEQEGILYAEIDPGQMAGPKWMLDVAGHYARPDVFELTVQTVARPMITSTQPR

SEQ ID NO: 317 - DNA, 993 bp, Unknown
  Obtained from an environmental sample
atgaccattgtaaaagccgctgccgtccaaataagccctgtcctttacagccgcgaaggcaccgtggacaaggttgtccagaagatcctcgaactcggcaagcaaggcgtccagttcgccactttcccggagacggtggtcccctactacccctacttctccttcgtccagtcgggctacgccctcaaggtgggcaaggaacatctgcgcttgctcgaacagtcggtcaccgtgccatcggccaccacgctcgccatcggcgaagcctgcaagcaggcggggatggtggtgtccatcggcgtcaacgaacgcgacggcagcacgatctacaacacgcagctgctcttcgatgccgacggcaccttgattcagcgccgccgaaagatcagcccgaccttccatgaacgcatggtctggggccagggcgacggctccgggctgcgcgcggtcgacagcgcggtcgggcgcatcggccagttggcgtgctgggagcactacaacccgctggcccgctacgccatgatggccgacggcgagcagatccactcggcgatgtaccccggttccttcgcaggcgacgccttctccgaacagatccaggtcaacatccgccagcacgcattggaagccggctgcttcgtcgtgaacgccaccgcgtggctggacgccgatcagcaggcgcagatcatgcaggacaccggttgcgccatcggcccgatctccagtggttgcttcaccgccatcgtttcgccggacggcgtgttgctgggcgagcctctgcggtccggtgagggcgaggtgattgccgatctcgacttcacgctgatcgacaagcgcaagcagatgatggattcacgcgggcactatgcgcgcccggaattgctcagcctgttgatcgaccgcacggcgaccgcgcatgtgcatgagcgcagcgcgcatccgaaggcgactgccgagcaggcggacggtccatccgccgtgaatgcgcagtaa

SEQ ID NO: 318 - protein, 330 aa, Unknown
  Obtained from an environmental sample
MTIVKAAAVQISPVLYSREGTVDKVVQKILELGKQGVQFATFPETVVPYYPYFSFVQSGYALKVGKEHLRLLEQSVTVPSATTLAIGEACKQAGMVVSIGVNERDGSTIYNTQLLFDADGTLIQRRRKISPTFHERMVWGQGDGSGLRAVDSAVGRIGQLACWEHYNPLARYAMMADGEQIHSAMYPGSFAGDAFSEQIQVNIRQHALEAGCFVVNATAWLDADQQAQIMQDTGCAIGPISSGCFTAIVSPDGVLLGEPLRSGEGEVIADLDFTLIDKRKQMMDSRGHYARPELLSLLIDRTATAHVHERSAHPKATAEQADGPSAVNAQ

SEQ ID NO: 319 - DNA, 1017 bp, Unknown
  Obtained from an environmental sample
atgacgaccccgcgtatcgtccgcgtcgccgcggtgcagatggcgcccgacctggaatccgcacacggcacggtagacaaggtctgccgcgccattctggaggccggcgaaaaaggcgcgcgcatggtggtctttcccgagaccttcgtgccctactacccctacttctccttcatccagccggcggtgacgatgggcgccgcccacctcgagctctacgagcgcgcggtgacggtgcccggcccggtcaccctggccgtgggcgaagcggcgcggcgggcgggcgcggtcgtcgtgctcggcgtcaatgaacgcgaccacggctcgctctacaacacccagctgatcttcgacgagaccggcgcgctggtgctcaagcgccgcaagctcaccccgacctatcacgagcgcatggtgtggggccagggcgatggcagcggtctcaaggtggtggacaccggcatcggccgcatcggcgcgctggcctgctgggagcactacaacccgctcgcccgctacaccctgatggcgcagcatgaagagatccacgccgcgcagttccccggttccatggtcggccagatctttgccgaccagatggcggtgaccatccgccaccacgcgctggaatccggctgcttcgtggtgaacgccaccggctggctcaccgatgcgcagatcaccgccatcacccccgacccggccatgcagcgcgcgctgcgcggcggctgccacaccgccatcgtgtcgccggaaggcagctacgtctgcgaaccgctcaccgagggcgaaggcatgctggtggccgacctcgacatgcggctggtcaccaagcgcaagcggatgatggattcggtcggccactacgcccggccggagctgctttcgctcaacgccgatcttgcccccaagccggcgctgcacacacagccggctgcgtccctccctctctcccttcaggcaggagccgaccatgtcgacgacgaccgcaccgcgtccgcaacagctgatctctga

SEQ ID NO: 320 - protein, 338 aa, Unknown
  Obtained from an environmental sample
MTTPRIVRVAAVQMAPDLESAHGTVDKVCRAILEAGEKGARMVVFPETFVPYYPYFSFIQPAVTMGAAHLELYERAVTVPGPVTLAVGEAARRAGAVVVLGVNERDHGSLYNTQLIFDETGALVLKRRKLTPTYHERMVWGQGDGSGLKVVDTGIGRIGALACWEHYNPLARYTLMAQHEEIHAAQFPGSMVGQIFADQMAVTIRHHALESGCFVVNATGWLTDAQITAITPDPAMQRALRGGCHTAIVSPEGSYVCEPLTEGEGMLVADLDMRLVTKRKRMMDSVGHYARPELLSLNADLAPKPALHTQPAASLPLSLQAGADHVDDDRTASATADL

SEQ ID NO: 321 - DNA, 993 bp, Unknown
  Obtained from an environmental sample
atgagagttgtcaaagccgctgctgtccaactgagtcctgtcctccatagccgcgacggaacggtcgaaaaggtcgtgcggaagatccatgaactcgccgaagagggagtcgagttcgccacctttcctgagaccgtggtgccttactacccgtacttttccttcgttcagacgcccttgcagcaaatcttcggaactgagtatctgaggctgctcgaccaggcagtcaccgtgccatccgctgccaccgacgcgatcggcgaggctgccaggtgggctggacttgttgtctcgatcggcgtcaacgagcgagacgggggaactctctacaacactcagcttctcttcgatgccgacggcagcttaattcagcggcgtcgcaagatcacacccacccattacgagcgcatgatctggggccagggcgacggctcaggtctgcgggccgttgatagcaaggccggccgcattggtcagctggcatgctgggaacacaacaaccccctggcgcgctacgcgctgatggccgacggcgagcagatccattcggccatgtatccgggctccatgttcggcgactcgttttcccaaaagaccgaaatcaatatccggcagcatgcgctggaatctgcgtgcttcgtcgtgaacgcaacggcctggctggacgccgatcagcaggcgcaaatcatgaaggacaccggctgcggcatcggcccgatctccggcggttgcttcactgcgatcgttgcacccgatggtagcctgctgggcgaacccatccgttccggtgagggcgtcgtcgtcgccaacctcgacttcacgctgatcgacaggcgtaagcaggtgatggactcgcgaggccactacagccggccggagttgctcagcctcttaatagaccgcactcctaccgcgcacgttcacgaacgcgctacgcaccccacgacaggagctgagcaaggctccgaggatgtgttcgaggctcgcatttaa

SEQ ID NO: 322 - protein, 330 aa, Unknown
  Obtained from an environmental sample
MRVVKAAAVQLSPVLHSRDGTVEKVVRKIHELAEEGVEFATFPETVVPYYPYFSFVQTPLQQIFGTEYLRLLDQAVTVPSAATDAIGEAARWAGLVVSIGVNERDGGTLYNTQLLFDADGSLIQRRRKITPTHYERMIWGQGDGSGLRAVDSKAGRIGQLACWEHNNPLARYALMADGEQIHSAMYPGSMFGDSFSQKTEINIRQHALESACFVVNATAWLDADQQAQIMKDTGCGIGPISGGCFTAIVAPDGSLLGEPIRSGEGVVVANLDFTLIDRRKQVMDSRGHYSRPELLSLLIDRTPTAHVHERATHPTTGAEQGSEDVFEARI

SEQ ID NO: 323 - DNA, 951 bp, Unknown
  Obtained from an environmental sample
atgagcaacgtgaaagtcgcggtcgtgcaacgcgcgccggtgttcggcaaccgcgccgccaccctcgatcgcgccgtcgccgcgctggccgaagcggcgcagcagggggcgaagctggtcgtgatgcccgagcacttcatccccggctacccggcctggatctggcgcctgcgtccgggcaccgacctgcgattgtgcgaacagctgcacgcgatgctgcgcgccaacgccgtgaggctggatgacggtgacctggccccgttgaccgaggccgcgcagcggcatgcgctcaccgtggtctgcggcgtctgcgagatcgacaccgaattcagtcgcggcaccctgtacaacaccgtggtcgtgatcgggcccgacggcacgctgctcaaccggcatcgcaagctgatgcccaccaaccccgagcgcatggtctggggcatgggcgacgccacggggctgaaggtggtcgacacgccctgcgggcgcatcggcacgctgatttgctgggagaactacatgccattcgcacgcgccgcgctgtacgcgcagggggtcgaggtcctggttgcaccgacctacgacgaaggcccggtatggctggcgtcgatgcagcacatcgcccgcgaaggcggctgctgggtggtgggcaacggctgcgcattccagggccgcgacatgccggacaccttgccgggcaaggcccagctgtttcccgaggccgacgcctgggtcaacgccggggactcggtcatcgtcgcgccaggcggccggacagtggcgggtccgttgcacgaggcgttcgggctgttcaccgccgagatcgacctctcccgggtcggaatggcccggcgcagcctggatgtggccgggcactatggacggcccgacatcttctgcctgcaggtcaacgcccgggcgcagccgccggttgaggtgacgcaccatggctga

SEQ ID NO: 324 - protein, 316 aa, Unknown
  Obtained from an environmental sample
MSNVKVAVVQRAPVFGNRAATLDRAVAALAEAAQQGAKLVVMPEHFIPGYPAWIWRLRPGTDLRLCEQLHAMLRANAVRLDDGDLAPLTEAAQRHALTVVCGVCEIDTEFSRGTLYNTVVVIGPDGTLLNRHRKLMPTNPERMVWGMGDATGLKVVDTPCGRIGTLICWENYMPFARAALYAQGVEVLVAPTYDEGPVWLASMQHIAREGGCWVVGNGCAFQGRDMPDTLPGKAQLFPEADAWVNAGDSVIVAPGGRTVAGPLHEAFGLFTAEIDLSRVGMARRSLDVAGHYGRPDIFCLQVNARAQPPVEVTHHG

SEQ ID NO: 325 - DNA, 1077 bp, Unknown
  Obtained from an environmental sample
atgactgcaaaaaagattgtccgcgccgccgctgtccagctcaatcccgtgctggacagcgccgacggcacccttgtgaaagtgttgcaggcgattgccgacgccgcagcgcagggcgtgcaactgatcgtctttcccgagacggtggtgccctactatccttacttttccttcgtcacgcctgcggtttcgatgggcgcggcgcatctgaaactgtacgaacaatcgcccacggtgccaggtccactgaccgacgccgtcgccgcagccgcgcgggcacatcagatggtggttgtgctcggcgtcaacgagcgcgatcacggcacgctctacaacacgcaactgatcttcgacgccgacggcacgctcccactgaagcgtcgcaagatcacgccgacctatcacgagcgcatggtctggggcatgggcgatggctccggcctgcgcacggtgaagaccgaggtcggaaccgttggcgcgctggcctgctgggaacactacaacccgctggcacgctacgcgctgatggcgcagcacgaagagatccattgcagccagttccccggctcgctggtcggcccgatcttttccgagcagatggaaatcaccatgcgtcatcacgcgctggaatccggctgcttcgtcgtcaacgccactgcatggctgacgcctgagcaggtgcgatcacaggcgccaacaccggcaatggaaaaagccttctccggtggttgctacaccgcgatcatttcgccggaaggaaaacatctgggcgaacctcttcgcgacggcgaaggcatggtcatcgccgatcttgattttgatctcatcaccaagcgcaagcgaatgatggattcggttggccactacgcacggccggaattgttgagcctgcagctcgacaaccgatcaactgcaccgctgacaacgtcgccggtggccgccgcagcgccgtcgcttgcagagatggaagcacagcgcctgtcacgttatctcgatgccagctccggcagcgccgcacaaggcatcgaagccgcctacatcaatgccctcagctctttttcaggaaaaccctcatga

SEQ ID NO: 326 - protein, 358 aa, Unknown
  Obtained from an environmental sample
MTAKKIVRAAAVQLNPVLDSADGTLVKVLQAIADAAAQGVQLIVFPETVVPYYPYFSFVTPAVSMGAAHLKLYEQSPTVPGPLTDAVAAAARAHQMVVVLGVNERDHGTLYNTQLIFDADGTLPLKRRKITPTYHERMVWGMGDGSGLRTVKTEVGTVGALACWEHYNPLARYALMAQHEEIHCSQFPGSLVGPIFSEQMEITMRHHALESGCFVVNATAWLTPEQVRSQAPTPAMEKAFSGGCYTAIISPEGKHLGEPLRDGEGMVIADLDFDLITKRKRMMDSVGHYARPELLSLQLDNRSTAPLTTSPVAAAAPSLAEMEAQRLSRYLDASSGSAAQGIEAAYINALSSFSGKPS

SEQ ID NO: 327 - DNA, 975 bp, Unknown
  Obtained from an environmental sample
atggttgatcaaatacttaacgatcgttctgaattattaacagttggtttggcgcagattgctccaatctggctgaaccgcgaaaaaacacttgcgaaagtggttgagaaagtaaatcaagctgcaaagcaagattgtcatcttgttgcttttggtgaagctttggtccccggatatcccttttggattgaacttacagatggcgcgcgattcaactccaatgttcaaaaagaaattcacgcgcactatatggatcaggcagtacagatagagaatggtcatttaaaagcgctttgtgaaacatcggccgcaaacaagattgccgtgatcgttgggtgcattgaacgcgcagccgatcgcggcgggcacagcttatatgcttcattggtttttattaatcctcaagggcaaatcggatcggtgcatcgcaaacttatgccaacttatgaagaacgtttaacctggtcacctggcgatggacatggtttgcgaacgcatcaactaggtgctttcactgttggcggcttgaattgttgggaaaactggatgccattgccacgcgccgcattgtacgcacaaggtgaagactttcatgtcgcaatctggccgggaagcattcacaatacgcaagatattacgcgctatattgcgaaggaatccagatcgtttgtaatgtctacttccgggttcatgcgtaaagaagactttccatctgatacgcctcacttagacaaaatacttgcaaactctccgaatgtacttgcaaatggtggatcctgtctcgccggaccggacggtcagtggatcgttgaaccatttgtgaatgaggaaaaattagttgttgcgactgtgaaccacaagcaggtccgtgaagaaagacaaaattttgatccggtcggacactattcccgtcctgatgtcacgcagttgattgtgaacagacaaagacaatcaacaatcaagctcaacgattaa

SEQ ID NO: 328 - protein, 324 aa, Unknown
  Obtained from an environmental sample
MVDQILNDRSELLTVGLAQIAPIWLNREKTLAKVVEKVNQAAKQDCHLVAFGEALVPGYPFWIELTDGARFNSNVQKEIHAHYMDQAVQIENGHLKALCETSAANKIAVIVGCIERAADRGGHSLYASLVFINPQGQIGSVHRKLMPTYEERLTWSPGDGHGLRTHQLGAFTVGGLNCWENWMPLPRAALYAQGEDFHVAIWPGSIHNTQDITRYIAKESRSFVMSTSGFMRKEDFPSDTPHLDKILANSPNVLANGGSCLAGPDGQWIVEPFVNEEKLVVATVNHKQVREERQNFDPVGHYSRPDVTQLIVNRQRQSTIKLND

SEQ ID NO: 329 - DNA, 1023 bp, Unknown
  Obtained from an environmental sample
gtgccggccaaagtacgcgccgccgccgtgcagctcagccccgtgctcttcagccgtgaaggcacgaccagcaaggtctgcgacaagattgccgaggcggcggcgcagggcgccgagctggtggtgtttcccgaaaccgtagtgccgtattacccgtatttctcgttcatcaaggctccggccgtgatcggcgccgagcacttactcttgctcgaacaagccgtcacggtgcccgggcccagcgtcgaagccatcgcagaagccgctcgcaaggcgggcgcggtggtttcgatcggcgtcaacgaacgcgatcacggcacgctgtacaacacccagctgttgttcgacgccgacggtcggttggcgcaagcccgccgcaagatcacccccacgtatcacgagcggatgatctgggggcagggcgatggctcgggcttggtggcggtggatacgcgagtcggcaggattggctccctggcgtgctgggagcactacaacccgctggctcgctatgcgctgatggccgaccacgagcaaattcacgtggccatgttccctggctcgctcgtgggcgacatcttccgcgagcaaatcgaggtcacgattcggcaccacgcgctcgagtcgggctgcttcgtcgtcaacgcgacgggctacctgagcgacgcgcaggtgacgcagatcgcgggcgacaccaagctcgaccgcgccctgcgcggcggttgcttcaccgccatcgtatcgcccgagggcacgctgctggcgccaccgctcaccgacggtgagggcatggtcattgccgacctcgatctgtcgctcatcgccaaacgcaaacgcatgatggacagcgtcggccattacagccggcccgagctgctcagcgtgctgatcgaccgctcgccgcagccgcatttgcgcgagaaaactgcctctttacccgaacctcggatgtcccatgaatcgctcgctcccgatagtaacggcctccgcgacgctgacgcgaaagcctcgaccctctcctga

SEQ ID NO: 330 - protein, 340 aa, Unknown
  Obtained from an environmental sample
VPAKVRAAAVQLSPVLFSREGTTSKVCDKIAEAAAQGAELVVFPETVVPYYPYFSFIKAPAVIGAEHLLLLEQAVTVPGPSVEAIAEAARKAGAVVSIGVNERDHGTLYNTQLLFDADGRLAQARRKITPTYHERMIWGQGDGSGLVAVDTRVGRIGSLACWEHYNPLARYALMADHEQIHVAMFPGSLVGDIFREQIEVTIRHHALESGCFVVNATGYLSDAQVTQIAGDTKLDRALRGGCFTAIVSPEGTLLAPPLTDGEGMVIADLDLSLIAKRKRMMDSVGHYSRPELLSVLIDRSPQPHLREKTASLPEPRMSHESLAPDSNGLRDADAKASTLS

SEQ ID NO: 331 - DNA, 1041 bp, Unknown
  Obtained from an environmental sample
atgtccggaacaggacctatcggaccggtcgtgaaggtcgccgtcgtacaagccgcgccatgtctgctcgatcttgatgcgggcgtcgagaaggcgatcgccttgatcgaccaagcgggcaaggctggcgcgcggctcatcaattttcccgaaatttggctgccgggttatccttggtggatctggctgaatccacccgccatcaacatgcagtatgtcgcgccttacatgaacaactccattgtcgcaggcagcaagcatgaccacgcacttcgggccgccgcgcgccgcaacaatattcacgtcgtgatcggtgtctccgagcgcgccggcggcagtctgtacatggctcagtggcactatgggcccgagggcgaggtgatctcgcgtcgtcgtaagctaaaacccacccatgtcgaacgcagcgtctttggcgaaggcgacggcagcgacatgatcgttactcagaccgatttcgggcgcgtcggcgcgctatgctgttgggaacacctgcaaccgctgtcgaaatacgcgctcttttcccaggacgagcagattcattgcgcggcgtggcccgctttcagcctctatgcaaaactctcgaaggccttcagccccgaagtcagcgtcaacgtgaaccaaatctacgccgtagaagggcaatgcttcgtcctgtcgtcgtgctcggttatcgatcaggcgatctacgacacgttggtgcagaacgaattgcaccagaagttcctcgaggtgggcgggggctacagccgaatcttcgggccgaacggtgcggaattcggtgagaatctcccacccgatagggaaggcctggtggttgccgatatcgatctcggcctgatctcgcactccaagagtgccgctgatccggctggtcactacgcgagggccgacgctctggcgctcatgcataaccgtaatccccgccgtccggttatcggtttcggcgaggcgacgcgcaaggttgccgacgcactgcctaaaggcgcggaacccgcggaagcgctcgaagcggccgagtga

SEQ ID NO: 332 - protein, 346 aa, Unknown
  Obtained from an environmental sample
MSGTGPIGPVVKVAVVQAAPCLLDLDAGVEKAIALIDQAGKAGARLINFPEIWLPGYPWWIWLNPPAINMQYVAPYMNNSIVAGSKHDHALRAAARRNNIHVVIGVSERAGGSLYMAQWHYGPEGEVISRRRKLKPTHVERSVFGEGDGSDMIVTQTDFGRVGALCCWEHLQPLSKYALFSQDEQIHCAAWPAFSLYAKLSKAFSPEVSVNVNQIYAVEGQCFVLSSCSVIDQAIYDTLVQNELHQKFLEVGGGYSRIFGPNGAEFGENLPPDREGLVVADIDLGLISHSKSAADPAGHYARADALALMHNRNPRRPVIGFGEATRKVADALPKGAEPAEALEAAE

SEQ ID NO: 333 - DNA, 1038 bp, Unknown
  Obtained from an environmental sample
atggccattgaacatccccgctatcgggtcgctgccgttcaggcggcgccagagttccttaatctcgaggcaaccgttgacaagacgattgcgcttatcgaggaggccgcccgcggaggcgcaagtctcattgctttccctgaaacttggatacctggatatccatggtttgcctggcttggtgcgccgatctggggcatgaaattcatccaggcgtaccatgacaactcgatggtgatcgacggcgcccagtttgagcgtattgcgcaagcagcatcgcgttgcaacatcactgttgtgcttggctttagcgagaaggacgcaggaagcctgtatattgcccaggccatcctgagccctgaagggaagaccatcgccacgcgtcgcaagctgaaacccactcatgtcgaacgcgcgatcttcggcgaaggcgacggcagcgacctggcagttcacgacaccaagctcggcagggtgggcgccctttgctgctgggagcatcttcagccactttccaaatacgcgatgtatgctcagaacgagcaggtccatatcgccgcctggcccagtttttccctttacgtcgacgcggcttacgcgcttgggccagaggtgaacaacgccgcgagtcggttgtatgcggtcgagggccagtgcttcgtggttgcgccgtgtgcaacggtttcgcaaaagatgatcgatatgctttgcgagacacccgagcaacaagcgctcttgaagccggggggtggtcacgcgcaaatctacggtcccgacggacgatcgctggccgatccgctgcctccggacgcggaggggctgttgtatgcagacattgaccttgcagccatcaccctcgcgaaagcagctgcagatcctgctggccattactctcgccctgacgtgacacaactgctgcttgaccgcaatccaaagccccgtgtcgtgcatgctaagcccggccaaagcgccaacaacagctcacccggcatgcgggccgtcgagcataccgagctcgaagaaggtgaacaggcctga

SEQ ID NO: 334 - protein, 345 aa, Unknown
  Obtained from an environmental sample
MAIEHPRYRVAAVQAAPEFLNLEATVDKTIALIEEAARGGASLIAFPETWIPGYPWFAWLGAPIWGMKFIQAYHDNSMVIDGAQFERIAQAASRCNITVVLGFSEKDAGSLYIAQAILSPEGKTIATRRKLKPTHVERAIFGEGDGSDLAVHDTKLGRVGALCCWEHLQPLSKYAMYAQNEQVHIAAWPSFSLYVDAAYALGPEVNNAASRLYAVEGQCFVVAPCATVSQKMIDMLCETPEQQALLKPGGGHAQIYGPDGRSLADPLPPDAEGLLYADIDLAAITLAKAAADPAGHYSRPDVTQLLLDRNPKPRVVHAKPGQSANNSSPGMRAVEHTELEEGEQA

SEQ ID NO: 335 - DNA, 1053 bp, Unknown
  Obtained from an environmental sample
atgactacgcgcgtgattaaagtcgctgccgcgcagctgtctccggtgctggcaactgcatcggagcacagccgcgaggacacgattgcgaaagtgatcgacgccatcgctgcggcgtcgcaacagggcgcgcaactgattgtgtttccggaaacagtcgttccgtattacccgtatttttcatttatcacgcccgcggtaacgatgggtgccgaacatttgaaattgtacgaacaggcagtgacggtacccagcgcagcgacagatgctgtcgctgcggcggcaaaaaattatggcatggtagtggtgctcggaattaatgaacgcgatcacggctcgctgtacaacgcgcaattaattttcgacgccgatggtgagctgctattaaagcgtcgaaaaattacgccgacttatcacgaacgcatggtgtggggacaaggcgacggcagcggtttaaaagttgtcgatactgctgccggccgtgtcggcgcgctcgcgtgctgggaacattacaacccgctcgcgcgttacagcctgatggcacaacacgaagaaattcattgcagtcaatttccgggatcgttggtcggccctattttcgccgaacaaatggaaatcaccatgcgtcatcacgcactcgaatccggctgttttgtggtgaatgcaacggcctggcttagcgatacacaaatccaatcaattacccccgataaagccatgcagaaagcactgcgcggcggttgctacaccgcaatcatctcgcccgaaggcaaacatctgtgcccaccgctgtatgacggagaaggaataattgtggcggaattggacttcgcgttaatcaccaaacgtaaacgcatgatggattccgtcggccattacgcgcgaccagaactactttctttgctcctcgatgatcgcgtaactgcgccgctcaaaaacttacagacgacgatggcctctgccaaatccgctgaagatggttttcctttatttgcagacgttttatatccagacagttctttcattgagacgtcgaaattcgcggagtcatga

SEQ ID NO: 336 - protein, 350 aa, Unknown
  Obtained from an environmental sample
MTTRVIKVAAAQLSPVLATASEHSREDTIAKVIDAIAAASQQGAQLIVFPETVVPYYPYFSFITPAVTMGAEHLKLYEQAVTVPSAATDAVAAAAKNYGMVVVLGINERDHGSLYNAQLIFDADGELLLKRRKITPTYHERMVWGQGDGSGLKVVDTAAGRVGALACWEHYNPLARYSLMAQHEEIHCSQFPGSLVGPIFAEQMEITMRHHALESGCFVVNATAWLSDTQIQSITPDKAMQKALRGGCYTAIISPEGKHLCPPLYDGEGIIVAELDFALITKRKRMMDSVGHYARPELLSLLLDDRVTAPLKNLQTTMASAKSAEDGFPLFADVLYPDSSFIETSKFAES

SEQ ID NO: 337 - DNA, 957 bp, Unknown
  Obtained from an environmental sample
atgaagggagtgtgtgccatgtcgacgaaagttgccatcgtccaggcgccgccggtcctgctgcatcgcgacaggacgattgcgaaggtgcgttcgtcgatcgaggatgccgccaatgcgggcgcctcgctgatcgtatttcccgaagcttatgtacccggctatccgagttggatctggcgtctcaggcccggaggcgacatgggactgtcgtctgagattcacgcaagattgcgggaaaatgccgttgatctcgcgaacggaggcctggcgcatgtccagggggctgcagcaaaattcggcgcgactgtcgttatcggcatcaatgaactcgacagcgagttcagcggaacgacattgttcaacaccgtggtggtcatcggccccgacggaacgcgcctcaacaggcatcgaaaattaatgccgaccaacccggagcgcatggtgtggggcacgggcgatgcctcgggtctgcgtgtcatcgatacgccggcgggacggctgggaaccatgatctgctgggagagctacatgccgctggcgcgctatgctctctatgcgcaaggcatcgagatatacgtcgctcccacgtgggacgcaggcgagagctggattgctacgatgcgccacatcgccaaggaggccggctgctgggtgatcggcacggcaaccgtcatccagggcagcgatgttccggacgattttcccgaacgcgacaagctcttcaagccggaggagtggatcaacgacggcgatgcggtcgtggtcaagcccatgggcgcgattgctgccggaccgcacaatcgacagaaaagcatactctacgccgacatcgaccgggaggccgcgcggcgagcccgccggtcgctcgatgtctgtggccactattcccgcccagacgttttctctttctcggtcaaccgaaagccattccgccctgccgactttgtgggttga

SEQ ID NO: 338 - protein, 313 aa, Unknown
  Obtained from an environmental sample
MKGVCAMSTKVAIVQAPPVLLHRDGRLRRCVRRSRMPPMRAPRSYFPAYVPGYPSWIWRLRPGGDMGLSSEITQDCGKMPLISRTEAWRMSRGLQQNSARLSLSASMNSTASSAERHCSTVVVIGPDGTRLNRHRKLMPTNPEHGVGHGRCLGSACHRYAGGTAGNHICWESYMPLARYALYAQGIEIYVAPTWDAGESWIATMRHIAKEAGCWVIGTATVIQGSDVPDDFPERDKLFKPRSGSTTAMRSWSSPWARLLPDRTIDRKAYSTPTSTGRPRGEPAGRSMCGHYSRPDVFSFSVNRKPFRPADFVG

SEQ ID NO: 339 - DNA, 1020 bp, Unknown
  Obtained from an environmental sample
atgtcaggatcattcaaagttgcagcagtgcaggcggctccggccttcctcaatctcgatgcgggcatcgacaaggcggtggcgctgatcgagcaagccgccgcgcaggacgttcagctcatcgcctttcccgagacctggttgcccggatacccctggtggatctggctcgatgcacccgccgttaccatgggctatgtcgttccctacaatctcaattcactagaggcgggcagcccgcaggacaagcgtctggcaaatgccgcgcgtgagaacaacatccaggtggtgatgggtctgtctgaacgccatgacggcacgctctacatcgcgcagtggcactatggtgaagatggcgaggtgatctcgcgacggcgcaagctcaagccgacccatgtcgaacgcacggtgttcggggaaggcgacggcagcgacatggtggtcaaggacacaagtctgggacgggtcggcgctctgtgctgttgggaacacctgcagccgctcaacaaatacgcgatgtactcccagaacgagcagatccacatcggttcctggcccagcttcagcctctacaagggcggcgcctatgcgcttggggcagacctcaacacggcggcaagccagatgtatgcggccgagggccagtgctttgttctggctgcctgcgccacggtcagtcaggacatgttcgacatgctctgcgacacggaaatgaagcagcagttcctgaccaccggtggcggattcgcccgcattttcggacctgacggctcgcccatgggcaatgtgcttgaagaacatgaagaagggctggtgatcgccgaaatcgatctcaccatgattgcgatcgccaaggcggcggctgacccgtgcgggcactattcccggcccgatgtgttccgactgatgttcaaccagaagccaagcccggtggtgatgccattcgaaaacgacgtggcccgcgagattgtcgaggccgccgaggatcaggtcagcgcaaaccggctcgcagcggaatga

SEQ ID NO: 340 - protein, 329 aa, Unknown
  Obtained from an environmental sample
MSGSFKVAAVQAAPAFLNLDAGIDGGGADRASRRAGRSAHRLSRDLVAGYPWWIWLDAPAVTMGYVVPYNLNSRGGQPAGQASGKCRAEQHPGGDGLSERHDGTLYIAQWHYGEDGEVIATAQAQADPCRTHGVRGRRRQRHVVKDTSLGRVGALCCWEHLQPLNKTRCTPRTSRSTSVPGPASASTRAALCAWGRPQHGGKPDVCGRGPVLCSLPAPRSVRTCSTCSATRKSSSSTGGGFARIFGPDGSPMGNVLEEHERAGDRRNRSHHDCDRQGGGPVRALFPARCVPTDVQPEAKPGGDAIRKTWPARLSRPPRIRSAQTGSQRN

SEQ ID NO: 341 - DNA, 1056 bp, Unknown
  Obtained from an environmental sample
atggcactgaccaacccaaaatataaagtcgccgccgtccaggccgcgccagcgttcctcgatctggatgcgtccgtcgaaaaagcggtccggctgatcgacgaggccggcgccaagggcgcgcgcctcattgcgttcccggaaacctggatccccggctatccctggtggatctggctcggcgcgccggcctgggcgatcatgaaaggttttgtctcggcctatttcgacaattcgctcacctatgacagtccggccgcggacaaattgcgccaggccgccaagcgcaacgatatcgtcgtggtgctcggcctgtcggagcgcgacggcggcagtctctatatcgcgcaatggatcatcggcccggacggcgaaactgtcgcccagcgccgcaagctcaagccgacccatgtcgagcgttcggtgttcggcgagggcgatggcagcgaccttgccgtgcatgagctcgcgatcgggcgcgtcggcgcgctgtgctgctgggagcatctgcaaccgctgtcgaaatacgccatgtatgcgcagaacgagcaggttcacgtggcggcctggccgagcttttcgctgtacgatccgttcgcccatgccctcggtgcggaggtcaacaacgccgccagcaagatctacgcggtcgagggatcgtgcttcgtcgtggcaccctgcgccaccgtttcaaaggaaatgatcgacctgttgtgcgacacgccggacaagcacggtctgctgcacgccggcggcgggtttgccgcgatctacggccctgacggctcgccgatcggcgaccgcctggcgcccgaccaggaaggtctgatctatgccgatgtcgatctcggcatgatctcggtcgcgaaggccgccgccgatccggccggacattatgcgcggccggatgtcacaaggttgctgctcaacaaacgcccgggcaatcgtgtcgaggcgctggcacttccggtggatcaggttgcggcaggtgaggagatcccctcgatatcgcgatcggccagaggggttgccgaactgccaaacgcggccgaatag

SEQ ID NO: 342 - protein, 342 aa, Unknown
  Obtained from an environmental sample
MALTNPKYKVAAVQAAPAFLDLDAPSKKRSGSTRPAPRARASLRSRTWIPGYPWWIWLGAPAWAIMKGFVSPISTIRSPMTVRPRTNCARPPSATYRRGARPVGARRRQSLYRAMDHRPTAKLSPSAASSSRPMSSVRCSARAMAATLPCMSSRSGASARCAAGSICTAVEIRHVCAERAGSRGGLAELFATIRSPMPSVRRSTTPPARSTRSRDRASSWHPAPPFQRKSTCCATRRTHGLLHAGGGFAAIYGPDGSPIGDRWRPTRKVSMPMSISASRSRRPPDPAGHYARPDVTRLLLNKRPGNRVRRWHFRWIRLRQVRRSPRYRDRPEGCRTAKRGRI

SEQ ID NO: 343 - DNA, 942 bp, Unknown
  Obtained from an environmental sample
atgaagtcaaaaattgcggttattcagcgacctcctgtattgttagaccttcaggcttcaatcgcccgtgccattacttctgttgaggaagcggcaggcaagggatctgagctccttgtttttcccgagacatttctgcctggttatccgtcctggatctggcgtctcaagccgggcggagacatggtgctgacatctgaaatccacgcaaaatatcgcgcgaactctgttgatgttgagcgcggggatctggcccctttatgcgaagcggcggcgaaacacggcgtcacaattgtcatggggctcagtgaaattgatgggcgctacagcgggactacactctttaatacagtggtgaccattggcgcggaaggagagctccttaatagacaccgcaagctcatgccgacaaacccagagcgtatggtctgggggcaaggggatgcctctggtctgcgggttgtcgacacgcccgtgggccgcgtcggcacgctgatctgctgggaaaactacatgccgctatcgcgctatgcgctttattctcaaaacattgacatctatgtggcgccgacctgggacgcgggcgagagctggatcgcctccatgcagcatatcgccaaagaaggtggctgctgggtgatcggcacggccacggcgatggagggctctgatgtcccagccgacttccctcagcgggaggtgcttttccctgatagcagcgaatggatcaatgacggtgacgctgtagtggttaaacccatgggggcgattgtcgcgggtccgcatcaccgggataagagtattctctatgctgagattgacgtcgaagtggcacgcaatgcgcggcgctcgctcgatgtggcggggcattactcccggccggatattttttcctttggcgtggatcgccggcctttgccgccggttacgtttgaggattga

SEQ ID NO: 344 - protein, 303 aa, Unknown
  Obtained from an environmental sample
MKSKIAVIQRPPVLLDLQASIARAITLLRKRQARDLSSLFFPRHFCLVIRPGSGVSSRAETWCHLKSTQNIARTLDVERGDLAPLCEAAAKHGVTIVMGQNWALQRDYTLYSGDHWRGRRLLNRHRKLMPTNPERMVWGQGDASVCGLSTRPWAASARSAGKTTCRYRYALYSQNIDIYVAPTWDAGESWIASMQHIAKEGGCWVIGTATAMEGSDSQPTSLSGRCFSLIAANGSMTVTLWLNPWGRLSRVRITGIRVFSMLRLTRSGTQCAALARCGGALLPAGYFFLWVDRRPLPPVTFED

SEQ ID NO: 345 - DNA, 1011 bp, Unknown
  Obtained from an environmental sample
atgaaagcgatcaaggccgctgccgtgcaggcagcaccggtattcctgaacctcgacgcatcgatcaccaaggcggaaacattcgtcgccgaggccgccgcgaatggtgccaagctggtggcgtttccggaaacctggctgccgggctatccctggttcatctggctcggtgcgcccgccgaaggcatgcagttcatcccgcgctatcacgaaaacagcatggagctccgctcgcccgagatgcgccgcttgcaggcgatcgcgcgcaagtatgaagtgacgctcgtcatgggctattccgagcgcgatggtggcagccgctacatgtcccaggtcattattggcgatcagggcgacatccttctcaatcgccgtaaattgaagccaacccatgtcgagcggacggtcttcggcgaaggcgacggttcggacctggtggtggtcgaaacggcattcggcaggctcggtgcgctcaattgctgggaacatatccagccgctcgtcaagatgtcgatgtatgcccagcatgaggaaatccatgtcgcgggttggccgagcttctgcgtctaccgcgatctcgcctatgccctgggaccggaagtcaacaatgccgtcagtcaggtctatgccgtggagggtagcgcctatgttctggcaccctgtgcgatcgtaagccaggagatgttcgacattctggccgacaagcctgaaaaggcctttctcctcaatccccgcacatccaagcccggcggtggcttcacgcagatctatgcgccggatggtcgaccgctttgcgagccgcttgccgacgatgtggaaggcatcctctatgccgatctcgatccggcaacgatcgccgtcgcgaaggcggccgccgatcctgcggggcactattcgcggccggacgcactctcgctggtgatcaatcgcgaaaagcgcgcggtgatggctgaaatcaacgcgccggcgacgccgaccttcacccccatctccctggacgctgcggagtag

SEQ ID NO: 346 - protein, 329 aa, Unknown
  Obtained from an environmental sample
MKAIKAAAVQAAPVFLNLDASITKAETFVAEAAANGAKLVAFPETWLPGYPWFIWLGAPAEGMQFIPRYHENHGAPLARDAPLAGDRAQVSDARHGYSERDGGSRYMSQVIIGDQGDILLNRRKLKPTHVERTVFGEGDGSDLVWSKRHSAGSVRSIAGNISSRSSRCMYAQHEEIHVAGWPSFCVYRDLAYAWDRKSTMPSVRSMPWRVAPMFWHPVRSARRCSTFWPTSLKRPFSSIPAHPSPAVASRRSMRRMVDRFASRLPTVEGILYADLDPATIAVAKAAADPAGTIRGRTHSRWSIAKSARWLKSRAGDADLHPHLPGRCGV

SEQ ID NO: 347 - DNA, 909 bp, Unknown
  Obtained from an environmental sample
atgaaagtcgcggcgattcaagcggcgccggtctacttggaccggcaagccacgctggaaaaggcgctttctctaatggatgaagcggccgcaaacggcgcccaagtctgcgccttccctgagaccttcctcgcgggctatcccgtctggatggacttgacggacggcgccaagtggaatgacgacaaacaaaaagcggcctacgcatgttatgtagatgcggccgtcgaagccgacggacctgagttgcaagccattgccaagaaatcgaaggcgctcggcctgttcacctatctgggcatggtcgaacgcgcggcgtcggccgggtcagtatattgttccctcgctgccttcgatcccgacaagggtctcgtcagcctacaccgaaaactcatgcccacctacaccgagcgcctcgtgtggagccaaggcgacggacacggactccaggtgcatgaattcgccggcttcaaaatcggcgcgctaaactgctgggaaaattggatgcccctcgcccgttacgcaatgtacgcccagggcgaacagctccacgtcgcgacctggcccgggtccccctggctcaccaaggacatcacccgtttcatcgcccttgagggacgcatctacgtcatgtccgttggcggcgtccttagcgcaaacgatatccccgactccttcccgcttaaaaccgacctcctcaagatccgagaccgctacctcagcggcggcaccatgatagtcgccccagacggcaccaccctcgaaggccccgccaaaaacgaagagaccatactctacgcggagctcgacctcaacaccgtcctccaagaacgccaaaatttcgatcccgcgggacactacgcgcgcccagacgtcttccaattggaaatcgacaaaaatcgacgatag

SEQ ID NO: 348 - protein, 297 aa, Unknown
  Obtained from an environmental sample
MKVAAIQAAPVYLDRQATLEKALSWMKRPQTAPKSAPSLRPSSRAIPWMDLTDGAKWNDDKQKAAYACYVDAAVEADGPELQAIAKKSKALGLFTIWAWSNARRRPGQYIVPSLPSIPTRVSSAYTENSCPPTPSASCGAKATDTDSRCMNSPASKSARTAGKIGCPARYAMYAQGEQLHVATWPGSPWLTKDITRFIALEGRIYVMSVGGVLSANDIPDSFPLKTDLLKIRDRYLSGGTDSRPRRHHPRRPRQKRRDHTLRGLDLNTVLQERQNFDPAGHYARPDVSNWKSTKIDD

SEQ ID NO: 349 - DNA, 1002 bp, Unknown
  Obtained from an environmental sample
atgacgtcccctgttcaaaccaagtacaaagtcgcctgtgttcaggcggcgcccgagtttctcgatctcgacaaaggcgttgccaaagcggtgcgcctgatcgaagaagccgccacccaaaaggcctcgctgatcgcgtttcccgaagtctggctccccggctatccgtggtggatctggctcgactcgccggcctggggcttgcagttcgtccagcgctacttcgaaaacgctctggtcgtcggcagcccccaatgggagcgcttgtgcaaggccgccgccgacaacaatatccatgttgtgctcggattctccgaacgggacggcagcacgctgtacctcgcacaggccatcatcgataacaccgggaaggtgatcgccacgcggcgcaaactcaagccaacacacgccgaacgcacggttttcggcgaaggcgacgggagccacatcgcggtgcatgaaaccactttgggccgcatgggtgcactctgctgcgccgagcacatccagccactgaccaagtacgccatgtactcgcagcacgagcagattcacattgccgcatggcccagcttctcggtctaccgcggagcagcgttccagctgagcgccgaagccaacaacgccgcgagccaggtctatgccctggagggcagttgctacgtggtggccccttgcgcgacggtgtccaaggagatgttggacatgctggctgattcgccgcaaaagaagcagctcctgctggaaggcggtggctacgccatgatttatgggcccgacgccaagcccctgtgcgagcccattccagagacagaagaaggcattctttacgcagatgtggacctgggcttcatcggtgtcaccaaggcagcgtatgaccccgccggtcactattcacgccccgacgtgctgcgccttttgttcaatcggaagcctgcccctcgggttcacgatttcgatcctgaatacacggccaccgagcagaagacagacgcggcctga

SEQ ID NO: 350 - protein, 333 aa, Unknown
  Obtained from an environmental sample
MTSPVQTKYKVACVQAAPEFLDLDKGVAKAVRLIEEAATQKASLIAFPEVWLPGYPWWIWLDSPAWGLQFVQRYFENALVVGSPQWERLCKAAADNNIHVVLGFSERDGSTLYLAQAIIDNTGKVIATRRKLKPTHAERTVFGEGDGSHIAVHETTLGRMGALCCAEHIQPLTKYAMYSQHEQIHIAAWPSFSVYRGAAFQLSAEANNAASQVYALEGSCYVVAPCATVSKEMLDMLADSPQKKQLLLEGGGYAMIYGPDAKPLCEPIPETEEGILYADVDLGFIGVTKAAYDPAGHYSRPDVLRLLFNRKPAPRVHDFDPEYTATEQKTDAA

SEQ ID NO: 351 - DNA, 936 bp, Unknown
  Obtained from an environmental sample
atgattacagcaggcatcgcagtcgccgctccggtggtgttggacaaaacaaaaaccattgagaaagccgttggcattattcacgaggcagcgggtaagggtgtgaacctgcttgtgtttcccgaggcatttattccctcctatcccgcctggggttggcgcctgcgtcccggtggagatttcgggttgtgcgaggagttgcacgccctgttgcttgataattcggtaaatttgcaaggtgatgacctggaccctgtccggggcgctgcagccgagcattcaatgaccgtggtgatgggattgaatgagcgcgaaggccagttcggtcgggctaccctgtttaacgccatggtatttatcggtccggacggcagcatcctgaaccatcatcggaaacttatgccaaccaatcatgagcgtacgattcatggcttcggcgatgcgcggggattgaaagtggtggataccccgtgcggtcgcgtgggtggtctgatttgctgggagaatttcatgcccctggctcgctacggcctgtatgcccagggcgtagaagtgtatgttgcgcccacctacgaccagggtgatgggtggataggatccatgcagcatattgcccgggaaggacggtgctgggtgttatcggccggaacaccgctacgcggcagtgattttcccgcggacatgccgggcaaggctcaactgtttcccgatgacgatgaatgggtgaatcccggtgggtcagtggttatcgcaccgggtggggaattagtggctggaccgcttttccgtgaggagggcatccttgtctgtgaattggatccggcgaaaagtgctcatgccaagcggtcctttgacgtggccggtcattacgccaggccagatattttcgagttggaaatagaccgtgatccacaggatcccgtcgagtgggactga

SEQ ID NO: 352 - protein, 301 aa, Unknown
  Obtained from an environmental sample
MITAGIAVAAPVVLDKTKTIEKAVALFTRQRVRVTCLCFPRHLFPPIPPGVGACVPVEISGCARSCTPCCLIIRNLQGDDLDPVRGAAAEHSMTVVMGEARRPVRSGYPVRHGIYRSGRQHPEPSSETYANQSAYDSWLRRCAGIESGGYPVRSRGWSDLLGEFHAPGSLGLYAQGVEVYVAPTYDQGDGWIGSAAYCPGRTVLGVIGRNTATRQFSRTCRARLNCFPMTMNGIPVGQWLAPGGELVAGPLFREEGILVCELDPAKSAHAKRSFDVAGHYARPDIFELEIDRDPQDPVEWD

SEQ ID NO: 353 - DNA, 1035 bp, Psuedomonas putida ATCC 700801
atgaatgcttcaaaaacacattataaagttgcagctgtgcaagccgctcctgaattcctggatttggacaaaggggttgataaggctatacgcctcattaaagaagcagctgataacggagcatcgctggttgcctttccggaagtttatcttccagggtatccgtggtggatctggcttggctctcccgcatggggaatgcagtttgttcagcgctacgtagaaaactcgcttgatttaaaaagcgagcagttcgagcgactgtgcaaagcggctgctacttaccgtattcacgttgtaatgggttacagcgaacgctcgtttggcaccctctacctcggtcaagcaattatcgatgacagcgggaaagtaattggtacgcgccgtaagctcaagcccacccatgctgagcgtactgtttacggtgagggtaacggcagtgacctcagggttttcaattcgcaacttggaagggtaggtgcactctgctgcgcagagcacgtacaaccactctcgaagtttgcgatgtacagccagcatgagcagttgcacattgcctcttggccgagcttctcggtatatcgcggtggcgcatatcaactgagcgctgaggctaactgcgcggccacccaagtctatgctcttgaaggccagtgcttcgtaatttcagcatgcgcaatcgtatctaaagacatgctaaacgttctcatcgacacccctgacaagggtaacctgttgcaggatggcggtggcttcgcgatgatttatggccccgatggcgcaccgctgtgtgaacccctgggcgaacatgaagaaggcatcctttatgccgacgtcgatttgggcgccatttccgtagctaaagcggcactcgacccggttggccattactcgcggccagatgttttgcgtctgcttttcaacgatcaaccgacaccttgcgtggaggcgttcaatccggctcctgtcggtactgatgctccaggtacagaccttcagggtgatgagcccgatgcgcaaccgatatctgaataa

SEQ ID NO: 354 - protein, 312 aa, Psuedomonas putida ATCC 700801
MNASKTHYKVAAVQAAPEFLDLDKGVDKAIRLIKEAADNGASLVAFPEVYSRVSVVDLAWLSRMGNAVCSALRRKRLIKASSSSDCAKRLLLTVFTLWLQRTLVWHPLPRSSNYRQRESNWYAPAQAHPCAYCLRGRQPQGFQFATWKGRCTLLRRARTTTLEVCDVQPAAVAHCLLAELLGISRWRISTERGLRGHPSLCSRPVLRNFSMRNVSKDMLNVLIDTPDKGNLLQDGGGFAMIYGPDGAPLCEPLGEHEEGILYRRRFGRHFRSSGTRPGWPLLAARCLRLLFNDQPTPCVEAFNPAPVGTDAP

SEQ ID NO: 355 - DNA, 1014 bp, Unknown
  Obtained from an environmental sample
atggccgtctctaaagacggtactgtttcaggaaagtcgcctatccgattgcatgtcgccgcgatacagatggtcccaaagctgggtgacgcgcaggcgaacgtgaatcaggcagaagcccttattcggaaggctcttgggctgggtgcgcgttggatcgtgttaccagagatgtttacctccggtgcggcgtttcatcccgacatgctcaaagccattcagccattcgatggcgccccactccagttgctgaaagacctttctcgcaagggcaatgctgtcatcggcggctcgtttctcgccaagcgtgggcaacaagtattcaataccttcgttttggtttctccggacgggtcagtcgtaacgcatgacaaggattcaccgacctattgggaaaattgctattaccggggcggtaccgatgatggcgtgttgtctacgcccattggcccggtcggctccgtcctctgttgggaatttatccgctcaagaaccgcgagacggctggcgaacaaggtcaagatggtcgtgggaggctcctgttggtggacgctccccgatgatgctgatccagacagcccgcgcagagccgtgaacctcaagatgctgcaagaagcgccggttcgcatggcgcggatgctgggtgttccggtaatacatggctcccacgcgggcagcttcgaaggattcttcagtccggaacttgcggatgttccctataactcgacgtacctgggcgagacaatgattgtcgacgcgggtggccgggtacttgcccgtagagcgcaagatgcaggcgaaggcgtggtaacggcagaagtggttttgcccgacaagtccgtaccaagcgaacccatcccggagactttctggattcccaaggaaatgccggatgattggaaagaagcctgggagcgttggttcgataccggtgcggattactacgagatggtgaccgcgccctttatcaagacgggtgtgataaacgagtacacaccggaatatcttaggtag

SEQ ID NO: 356 - protein, 325 aa, Unknown
  Obtained from an environmental sample
MAVSKDGTVSGKSPIRLHVAAIQMVQSWVTRRRTIRQKPLFGRLLGWVRVGSCYQRCLPPVRRFIPTCSKPFSFDGAPLQLLKDLSRKGNAVIGGSFLQAWATSIQYLRFGFSGRVSRNAQGSPTYWENCYYRGGTDDGVLSTPIGPSAPSSVGNLSAQEPRDGWRTRSRWVGGSCWWTLPDDADPDSPRRAVNLRCCKKRRFAWRGCWVFRYMAPTRQLRRILQSGTCGCSLLDVPGRDNDVDAGGRVLARRAQDAGEGVVTAEGFARQVRTKRTHPGDFLDSQGNAGIGKKPGSVGSIPVRITTRWPRPLSRRVTSTHRNILG

SEQ ID NO: 357 - DNA, 951 bp, Unknown
  Obtained from an environmental sample
atgacaaaactagccatcgtacaaaaaccgccagtctttctggataagcaaaaaaccattgagctggccgtcgccaacattgaagaggccgccgccaagggtgccgatctcgtggtgttttctgaagctttcattcccggctatcctgcctggatctggcgtctacgccccggcggtgactgggggctttcagaagagttgcaccagcgtttgctgcgcaatgccgtcaatgtggactccgatgatctggctccgttgtttgaggtcgcccgcaagcacgaactcaccatcgtttgcggtatcgaggagcgtgacaacaaactaagtcaaacaaccttatataacaccgtcatcacgattggtcccgatggatcgttactgaacaaacatcgcaagcttatgcccaccaacccggagcgaatggtgtgggggtttggtgacgcatccggtttaaaagtcgttgataccaatgctggtcgaattggctcattaatgtgctgggaaaattacatgccgctggctcgctatgccctatatgcacaaggtgtcgagatctatatcgcaccgacctacgacagcggtgatggctggataggcagcatgcagcacatcgcacgtgaagggggctgttgggtggtgggatgtgggtgtctcatgaaaggcagtgatattccagatgatttcccggagaaatccacgttgtatccagatgcagatgaatgggtgaacccgggtgattctgtagtgatagcacccggcggtgaaattatggccggcccaatgaacagagagtccggtattttgtatcacgagctagacagagaaaaagtcagcaacgctaaacgagcattcgatgttgccgggcattattcacgtcccgatatctttcagctgcatgtaaatacacaggagcagtcaccctgcgtattcgaaaataattccataacttaa

SEQ ID NO: 358 - protein, 300 aa, Unknown
  Obtained from an environmental sample
MTKLAIVQKPPVFLDKQKTIELAVPTLKRPPPRVPISWCFLKLSFPAILWIWRLRPGGDWGLSEELHQRLLRNAVNVDSDDLAPLFEVARKHELTIVCGRGAQQTKSNNLIHRHHDWSRWIYTNIASLCPPTRSEWCGGLVTHPLKVVDTNAGRIGSLMCWENYMPLARYALYAQGVEIYIAPTYDSGDGWIGSAAHRTRGLLGGGMWVSHERQYSMISRRNPRCIQMQMNGTRVILTRRNYGRPNEQRVRYFVSRARQRKVSNAKRAFDVAGHYSRPDIFQLHVIHRSSHPAYSKIIPL

SEQ ID NO: 359 - DNA, 1029 bp, Unknown
  Obtained from an environmental sample
atggcaaacgtcgttcgtgctgcggccgtacagttgagccctgttttgggtagtcgcgagggtacggtagagaaggtagttgctgcgatccgtgacgccgcctcgcagggcgcacagctgtgcgttttcccggagacggttgttccctattatccgtatttctcgttcattcggccgcccgcggccatgggcaaagaccacatgcagctgtacgagcaagctgtggtcgtgccttctcccagcacgaacgcgattgccgcggcggccaaacaacactcgatcgtcgtttcaatcggcgtcaatgaacgcgatcacggtacgatatacaacacgcagttgttgttcgatgccgacgggacactcgtgcaacggcgtcgcaagataacccccacgttccacgagcgtatggtgtggggtcaaggtgatgggtcgggtttgcgctgtgtcgacacacaaatcgggcgcatcggtagcctggcttgttgggaacattacaatcccttggcgcgctacgcattgatggccgatcacgaagagatccacgtcgccatgtttccgggttcgatggtgggtcagatcttcgccgatcaaattcaggtaaccattcgccaccacgcgctcgaaagcggctgtttcgtcgtcaacgctacggggtatctgagcaaggaacaggtcgcccagttgtcacaaggcacgtcgctcgacgcggcgttgaccggtggttgttacaccgcgattgtatcgcctgaaggcgtcgtactgggcgaaccgctcaccgacggcgaaggcatggtcgtggcggatatggatctcagcctcatcaccaaacgcaaacgcatgatggatagcgtcgggcactacagtcgcccggaattgctgtctctgctgatcaatcgaacgccaacccacacggcggtcgacgtcgaattcaactccaattccgagtctcatcatgtcagcaatacacgaacaccaaagcgcacaactggcccacgttcgaaccttcaagttgccgctgatcgcgagtaa

SEQ ID NO: 360 - protein, 335 aa, Unknown
  Obtained from an environmental sample
MANVVRAAAVQLSPVLGSREGTVEKVVAAIRDAASQGAQLCVFPETVVPYSVFLVHSAARGHGQRPHAAVRASCGRAFSQHERDCRGGQTTLDRRFNRRMNAITVRYTTRSCCSMPTGHSCNGRKITPTFHERMVWGQGDGSGLRCVDTQIGRIGSLACWEHYNPLARYALMADHEEIHVAMFPGSMVGQIFADQIQVPFATTRSKAAVSSSTLRGIARNRAQLSQGTSLDAALTGGCYTAIVSPEGVVLGEPLTDGEGMVVADMDLSLIPNANAWIASGTTVARNCCLCSITPTHTAVDVEFNSNSESHHVSNTRHQSAQLAHVRTFKLPLIAS

SEQ ID NO: 361 - DNA, 951 bp, Unknown
  Obtained from an environmental sample
atgctaaacgagaacaatggcgctactttcaaggttgctgccgtgcaggcttcaccggtatttcttgatcgcgctgctacaatcgacaaggcttgcgatttaattgctacggccggacgcgagggggctcgcctgatcgtctttccagaagcgttcgtcccggcctatcctgattgggtatgggcgattcccgcgggtgatgagggcatgctcaatgagctgtatgcagaattacttgccaatgctgtcaccattcccagcgatgcgaccgagaggttgtgtcgcgcggcgcggcttgctaatgcttacgtggtgatggggatgagcgaacgcaatgccgaagcgagtggcgccagcctgtataatacgctgttgtatattgatgcacagggacaaatcctgggaaagcaccggaagctggttccaacgggcggcgagcgcctggtatgggcacagggagatggcagcaccctggaggtttacgatactcctttgggaaaactcggtggcttaatctgctgggagaattatatgccgctggcacgctatactatgtatgcctggggcacgcaaatctacattgcagcgacgtgggatcgcgggcagccatggctatccactttgcgacacattgctaaagagggcagagtatatgtgatcggctgttgtattgctatgcgcaaagatgatatccccgaccattacgcgatgaaggagaagtattacgcggaagaagacgagtggatcaatattggcgatagcgcaatcgtcaatccagaaggggtatttattgccgggccagtgcgtaagcaagaagaaatcctctacgccgaggttgacccgcgaatgatgcaggggccaaagtggatgctcgacgtggcaggacattacgcgcgcccggatgtattccagttgacggtgcacacggagaggcggcagatgatccactag

SEQ ID NO: 362 - protein, 302 aa, Unknown
  Obtained from an environmental sample
MLNENNGATFKVAAVQASPVFLDRAYNRQGLRFNCYGRTRGGSPDRLSRSVRPGLSLGMGDSRGGHAQAVCELLANAVTIPSDATERLCRAARLANAYVVMGMSERNAEASGASLYNTLLYCTGTNPGKAPEAGSNGRRAPGMGTGRWQHPGGLRYSFGKTRWLNLLRIICRWHAILCMPGARKSTLQRRGIAGSHGYPLCDTLLKRAEYMSAVVLYAQRYPRPLRDEGEVLRGRRRVDQYWRRNRQSRRGIYCRASAARRILYAEVDPRMMQGPKWMLDVAGHYRARMYSSRCTRRGGRST

SEQ ID NO: 363 - DNA, 1053 bp, Unknown
  Obtained from an environmental sample
atgccgaaaaagtcgaccgtccgggtcgcagccgtccagattgcgccggatctgacatcgcgggaaaagacggtggcacgcgtgatcgaggcgatcgcccaggcatccgccaaaggtgcggagcttgtggtttttcccgagacctttgtgccgtggtatccttatttctcgttcgtgttgcccccggtcttgtcgggcaaggagcacctgcggctctacgaagaggcggttgcggtgccaagtgccgccacaagaagcgtagcggctgccgctcgcgaacatggcatcgtcgtggcgcttggcgtcaacgagcgcgactatggcacgctctacaatacgcaactgcttttcgatgccgatggcagtctgatcctgaagcggcgcaagatcaccccgactttccacgagcggatgatctggggccagggcgatgcctcaggcctgaaggttgtcgacagcgccattggccgcatcggcgcgctggcctgctgggaacactacaatccgctagcccgctatgcgctgatggcgcagcacgaggaaatccacattgcgcagtttcccggctccatggtcgggccgatctttgccgatcagatggaggtgacgatccgccatcacgcgctggaaagcggctgcttcgtcgtcaatgccacgggatggctgacggatgatcagatcgtctcgatcacaccggataccggcctgcaaaaagcgctgcggggtggctgcatgacggcgatcatttcccccgaaggcaagcatctcgtgccgccgctcaccgaaggtgagggtatcctcgtcgccgatctcgacatgagcctcattctcaagcgcaagcgcatgatggattcggtcggccactatgcccggcccgagttgctgcacctcgtcatggacgcccggccggctgcgccgatgagggaatcgtccatgcccactgccttccccggcgaaacattgacaaccgacatgaccgatggagaacaggatgcgtctttcgacggaaacgctgatcaacgaattgcagtccttcggagcccggctggttga

SEQ ID NO: 364 - protein, 335 aa, Unknown
  Obtained from an environmental sample
MPKKSTVRVAAVQIAPDLTSREKGGTRDRGDRPGIRQRCGACGFSRDLCRGILISRSCCPRSCRARSTCGSTKRRLRCQVPPQEARLPLANMASSWRLASTSATMARSTIRNCFSMPMAVSSGARSPRLSTSGSGARAMPQAEGCRQRHWPHRRAGLLGTLQSASPYALMAQHEEIHIAQFPGSMVGPIFADQMEVTIRHHALESGCFVVNATGWRMIRSSRSHRIPACKKRCGVAAGDHFPRRQASRAAAHRRGYPRRRSTASFSSASAWIRSATMPGPSCCTSSWTPGRLRRGNRPCPLPSPAKIDNRHDRWRTGCVFRRKRSTNCSLRSPAG

SEQ ID NO: 365 - DNA, 975 bp, Unknown
  Obtained from an environmental sample
atgacaaagctagccatcgttcaaaaaccccccgtctttctggataaagaaaaaaccatagcgaagacggttgattccataaaagaggccgcgacacaaaatgccgacttggtcatcttcaccgaagccttcatcccgggctaccccacctggatatggcgacttaggccaggcgctgattggggcctctcagaagagctgcacgagcagttattgcgtaacgcggtgagtatgggatcgaccgacctggatccgctttatgaagccgcccaacagcataacgtcactattgtttgcggcatcgtagaaagagaccaccaactcagccaatcaaccctctacaacagcatggtcgtcattgacacagacggaacccttctcaacaagcaccgcaaactcatgccaactaatcccgaacgcatggtgtggggctttggcgacgcctcaggactcaaagccgttgcaacacctgcaggccgcatcagcacgttgttgtgttgggagaactacatgccattggcccgatatgctctgtatgcacaaggcgtggaaatctatatcgcgccaacttacgacagtggtgcgggttggataggaagcttgcaacacatagcacgcgaaggtcgatgctgggtcgtgggctgtggcaacctgattcaggccagtgatctgcctgaagacttcccggacaaggacaacctctacccggacgcagaagagtgggtgaacccgggtgactccatagtcattgcaccagacggtgagattgtggccggtccaatgcacaaagagacaggaattttgtactgcgagatagatctggagaaagtcagaattgcaaaacgagcattagacgtgaccgggcattattcgcgaccggacgttttcaaactgcatgtgaatacccgacctcaatcacctgtggaatttgaaggtcaggagaccaacaatccaacaacaggagaaagctcatga

SEQ ID NO: 366 - protein, 315 aa, Unknown
  Obtained from an environmental sample
MTKLAIVQKPPVFLDKEKTIAKTVIPKRPRHKMPTWSSSPKPSSRATTWIWRLRPGADWGLSEELHEQLLRRGEYGIDRPGSALSRPTARHYCLRHRRKRPPTQPINPLQQHGRHHRRNPSQQAPQTHANSRTHGVGLWRASGLKAVATPAGRISTLLCWENYMIGPICSVCTRRGNLYRANLRQWCGLDRKLATHSTRRSMLGRGLWQPDSGSDLPEDFPDKDNLYPDAEEWVNPGDSIVIAPDGEIVAGPMHKETGILYRDRSGESQNCKTSIRRDRALFATGRFQTACEYPTSITCGIRSGDQQSNNRRKLM

SEQ ID NO: 367 - DNA, 981 bp, Unknown
  Obtained from an environmental sample
atgactgcccactttgccgataccctgaccgttgccgtggcccagatcgcgccggtgtggctacagcgcgaagctaccctgcaaaagatgctggtctgggtggagcgcgccgcgcgcgaaggcgcgggcctggtcgccttcagtgagggcctgctgcctggctaccccttctggattgaacacacggacggcgcccgcttcgagtcgccgttacagaagcgcctgtacgcccactactgcgatcagtcggtccagatcaatgctgggcacctcgcaccactctgcgctgccgcggccagacaccagatttgggtggtctgcggcgtcatcgagcgcgacagcgcacgcggactcagcgtgtttgcatcaatggtcaccatcgatgccgaaggcgcgatccgcagtgtgcaccgcaagctgatgccgacctacgaagaacgcctggtgtggtcgcccggcgacgcgcacggactgcgctgccatccgctcggccagttccgcctcggcagcctcaattgctgggagaactggatgccgctggcgcgcgccgccctgtacgcccagggcgagtctttgcatgttgcatcctggcccggcagtcgccgcaacaccgagaccattactcccttcatcgcccgcgaaggccgcagttacgcgctgtccgccagttccgtgctgcaccgggatgatctgcccgactccgttccggcgctgtcggtgctgcgcgactgcctgccggacgtgatggccgacggcggctcctgcgtcgccggccccgacggacatttcctgatcgagccggtcgtcggccgggaagagctgctgctcgcgcagatcgatcatgcccgggtacgcgaggaacgtcagaacttcgaccccttcggccactactcgcggccggaactcctgtcgctggtggtggatacgcgccgggcgagcggagtgcagatagtgaatgctgaccatggctttaagccctga

SEQ ID NO: 368 - protein, 317 aa, Unknown
  Obtained from an environmental sample
MTAHFADTLTVAVAQIAPVWLQREYPAKDAGLGGARRARRRGPGRLQGPAAWLPLLDTHGRRPLRVAVTEACTPTTAISRSRSMLGTSHHSALPARHQIWVVCGVIERDSARGLSVFAQWSPSMPKARSAVCTASCRPTKNAWCGRPATRTDCAAIRSASSASAAQLLGELDAAGARRPVRPGRVFACCILARQSPQHRDHYSLHRPRRPQLRASASSVLHRDDLPDSVPALSVLRDCLRTWPTAAPASPAPTDISSSRSSPGRAAARADRSCPGTRGTSELRPLGHYSRPELLSLVVDTRRASGVQIVNADHGFKP

SEQ ID NO: 369 - DNA, 1074 bp, Unknown
  Obtained from an environmental sample
atgtccgaagagaacaccaccaccgaatcaagctcggacgcgatctggaccgttgcggccgtccaggcggcgccggtgttcttgaatcgggatgcgacggtgcgtaaggccgtctcgctgattgccgaggccgcggcgcacggcgcgcgtctcattgtttttcccgaggcgttcattccatcgtacccggattgggcgtgggcggtcccgcccggacagggcggaaccaactcgagactgtatgccaaactgctcgacaattcggttacggtgcccagcccagccaccgatgccctggccagggcggctcgcgacgcgggcgcctacgtcgtcatgggcataaacgagcggaacacggcggcgagcggcggaagtctctacaacagcttgctctatattggtccggacggtcgcatcctgggcattcatcggaagttggtgccgacctcggcggagcggctgatctgggcacaaggcgatggaagcacgcttggcgtgttcgatacgccgggcggccggcttggcggcttgatctgctgggaaaactatatgccgctggcccgatattcgatgtacgcgcgcggcgtgcaaatatatgttgcggcgacctgggacaggggcgagccatggctttcgacgctgcgacacatagccaaggaaggccagacctacgtgataggctgttgcatcgccatgcggacggccgacatcgacgacgccgagctcgtcgagaagtattacgcggacgccggtgagtggatcaatgaaggcgacagcgcgattgtcgatccgagcggaacaatcattgccggtccggcccatcagaccaatgaaatcctctacgccgcgatcgatcgccagaaggtgctggaatcaaaatggatgttggacgtggccgggcactacgcgcgtccggacgtgttttcatttggcgttcgaaccgatgccaacccgataatgaccatgaacgaaccaagcgcgacggccgagccgaggcacaatagcgcgggagccgagggtcgcgacggcctacgcgggcgtcgtgaccctcgctcgagaattcggcagatgtag

SEQ ID NO: 370 - protein, 346 aa, Unknown
  Obtained from an environmental sample
MSEENTTTESSSDAIWTVAAVQAAGVLESGCDGAGRLADCRGRGARARLIVFPEAFIPSYPDWAWAVPPGQAEPTRDCMPNCSTIRLRCPAQPPMPGQGGSRRGRLRRHGHKRAEHGGSGGSLYNSLLYIGPDGRILGIHRKLCRPRRSGSGHKAMEARLACSIRRAAGLAASAGKTICRWPDIRCTRAVQIYVAATWDRGEPWLSTLRHIAKKARPTAVASPCGRPTSTTPSSSRSITRTPVSGSMKATARLSIRAEIIAGPAHQTNEILYAAIDRQKVLEKMDVGRGRALRASGRVFIWRSNRCQPDNDHERTKRDGRAEAQRGSRVATAYAGVVTLAREFGRC

SEQ ID NO: 371 - DNA, 1014 bp, Unknown
  Obtained from an environmental sample
atgggtatcgaacatccgaagtacaaggttgcggtggtacaggcggcgccggcctggctcgatctcgacgcatcgatcgccaagaccatcgcgctgatcgaggaggcggccgccaagggcgccaagctgatcgcattccctgaggccttcattcccggctatccttggcatatctggatggactcgccggcctgggcgatcgggcgcggatttgtgcagcgctatttcgacaattcgctttcctacgacagcccgcaggccgaacggctgcggctcgcggtgaagaaggccggcatcaccgccgtgctcggcctgtccgagcgggaaggcggcagcctttatctcgcgcaatggctgatcggtcccgacggcgagaccatcgccaagcggcgcaagctgcggccgacgcatgccgagcgcaccgtctacggcgaaggcgacggcagtgaccttgcggtccatgaccgcgctgacattggccgtctcggcgcgctgtgctgctgggaacatctgcagccgctgtcgaaatacgccatgtatgcccagaacgagcaggtgcatgtcgcggcctggccgagtttttcgctgtacgacccgttcgcgccggcgctgggctgggaggtcaacaacgcggcatcccgcgtctatgcggtcgaaggctcctgcttcgtgctggcgccgtgtgccaccgtctcgcaggcgatggtggacgaactctgcgaccgcgacgacaagcatgcgctgctgcatgtcggcggcggccacgccgcgatctacggaccggacggcagctcgatggcgaacaagctcgatcccgagcaggagggcctgctgttcgccgacatcgatctcggggcgatcggggtggcaaagaacgccgccgatccggccgggcactattcgcggccggatgtgacccgtctgctcttgaacagaaaaccctcaaagcgcgtcgagcactttgcgctgccgctcgaccatctcgcggacgagggcgttgctccggtgacctga

SEQ ID NO: 372 - protein, 327 aa, Unknown
  Obtained from an environmental sample
MGIEHPKYKVAVVQAAPAWLDLDARSPRPSRSRRRPPRAPSSHSLAFIPGYPWHIWMDSPAWAIGRGFVQAISTIRFPTTARRPNGCGSRRRPHHRRARPVRAGRRQPLSRAMADRSTARPSPSGASCGRRMPSAPSTAKATAVTLRSMTALTLAVSARCAAGNLQPLSKYAMYAQNEQVHVAAWPSFAVRPVRAGAGLGGQQRGIPRLCGRGSCFVLAPCATVSQAMVDELCDRDQACAAACRRRPRRDLRTGRQLDGTSSIPSRRACCSPTSISGRSGWQRTPPIRPGTIRGRMPVCSTENPQARRALCAAARPSRGRGRCSGDL

SEQ ID NO: 373 - DNA, 1056 bp, Unknown
  Obtained from an environmental sample
atgacgaattttctggacgtgacggtggcagcggttcaggcggctcccgtctatttcgatcgggaggcatcgacggagaaagcgtgccggttgatccacgaagcggcagggctcggcgcgacgctcgcagcgttcggcgaaacctggttgccagggtatccgttcttcgtctgggggttcgcgcacaaccggagcctgttctggcaggccgccgccgagtacatcgccaatgcggtggagattccgagtcccacaacggaccgtctctgtgcggcggcgaaggctgccggggtcgacgtcgtcattggcgtcgttgaactggatgaacgaacacgagcttcggtttacagtacgctgcttttcatcggtcgcgacgggacgatcctgggccgccaccgcaagctgaagccaacacacatggagcggacgatctggggcgaaggggacgcatatggactccgcgtctacgaacgttcgtacgggcggctgagcggcctgaattgctgggaacacaatatgatgctgcccggctacgtgcttgccgcacagggcacgcagtttcacgtcgccgcatggcccggaaaggagaggctcaccgtcccgccgaacgaagcggcttatacgcgccagcttctcctctctcgcgcgtatgcatcccaggccggcgcgtacgtgatcagcgtcgccgggctgctcgcaccagactccatgcccgagcgttatcgcgagttagggcggtcatatgagttgaccggcgacagcgtcatcgtcgacccgcgcggcgaggtcattgccgggcctgcaaaaggcgagaccatcctgctcgcgcagtgcagtcaggaagctctcctcgcggccaagtccgccatcgacctcggcggccattactcacgcccggatatctttcagctgcgtgtcaacgatcaactgcagcatcgggtccggagagttgagccacacttcacggcggcgatcggacatatcggagccgagcgccgatcccaggaggatggtactggtcccttcgacctggcggaatctctcacgaactcctag

SEQ ID NO: 374 - protein, 351 aa, Unknown
  Obtained from an environmental sample
MTNFLDVTVAAVQAAPVYFDREASTEKACRLIHEAAGLGATLAAFGETWLPGYPFFVWGFAHNRSLFWQAAAEYIANAVEIPSPTTDRLCAAAKAAGVDVVIGVVELDERTRASVYSTLLFIGRDGTILGRHRKLKPTHMERTIWGEGDAYGLRVYERSYGRLSGLNCWEHNMMLPGYVLAAQGTQFHVAAWPGKERLTVPPNEAAYTRQLLLSRAYASQAGAYVISVAGLLAPDSMPERYRELGRSYELTGDSVIVDPRGEVIAGPAKGETILLAQCSQEALLAAKSAIDLGGHYSRPDIFQLRVNDQLQHRVRRVEPHFTAAIGHIGAERRSQEDGTGPFDLAESLTNS

SEQ ID NO: 375 - DNA, 939 bp, Unknown
  Obtained from an environmental sample
atgaccaaaatcgctgtcattcaagaacccccggtctatctgaatctgagcaaatcgatggaccgagcggtcgacttgattgccgatgccgcgagccaggggtgtcagttgattgtgtttcccgaagcctggcttgcaggttaccccaccttcgtctggcgtcttgcgccgggcagcggaatgggaaaaaccgatgagctttacgcgcgtttgctcgccaactcggtcgaccgcagcaaagaggggcttcggcctttgcaggaggctgcaaaagagcatggcgttgtcattgttctgggttatcaagaggtggacggctcgggcagcagcagcacaatcttcaacagctgcgcgattattgatgccgacgggcgactggccaacaaccatcgcaagttgatgcccaccaatgcggagcggatggtgtgggggtttggcgacggttcgggcctgaacgttgttgacaccgcggtgggcaggatcggcacgctgatttgctgggaaaactacatgcccttggcgcgctacgcgctgtatgcccaaaacatcgaaatctatgtggcgccgacctgggacagcggtgccatgtggcaagccaccctgcaacatatcgcacgtgaaggtggctgctgggtcatcggatgtgcaacctcgctgcaagcctctgacatcccggacgaccttccccatcgggatgagttattcccgaacaaagacgaatgggtgaaccctggcgatgcggtggtttacaaaccttttggcggccttgtggccggccccatgcatcaggaaaaggggcttctcatcgcagagttggacgtcgccgctgttcaggtctcacgtcggaagttcgatgcgaccgggcattacgctcgccccgatgtcttccaactgcacgtgaatcgcagcgcgatgcggccggttgagttcacgaattag

SEQ ID NO: 376 - protein, 312 aa, Unknown
  Obtained from an environmental sample
MTKIAVIQEPPVYLNLSKSMDRAVDLIADAASQGCQLIVFPEAWLAGYPTFVWRLAPGSGMGKTDELYARLLANSVDRSKEGLRPLQEAAKEHGVVIVLGYQEVDGSGSSSTIFNSCAIIDADGRLANNHRKLMPTNAERMVWGFGDGSGLNVVDTAVGRIGTLICWENYMPLARYALYAQNIEIYVAPTWDSGAMWQATLQHIAREGGCWVIGCATSLQASDIPDDLPHRDELFPNKDEWVNPGDAVVYKPFGGLVAGPMHQEKGLLIAELDVAAVQVSRRKFDATGHYARPDVFQLHVNRSAMRPVEFTN

SEQ ID NO: 377 - DNA, 1050 bp, Unknown
  Obtained from an environmental sample
atgtccagcaccacccatccccgcctgcgcgtcgccgcggtgcaagccgcccccgtcttcctcgacctcgacggcaccatcgacaagaccatcgacctgatggcccgggcggccggccagggcgtgcagctgatcgcctttcccgagacctgggtgcccggctatccgtggtggatctggctcgattcgccggcctggggcatgcagttcgtgcagcgctaccacgacaacgccctggtcgtcggctcgcccgagttcgaccgcattcgcgaggccgcgcgcaagcaccgcatctgggtctcgctcggctacagcgagaaggccgccggcagcctctacatcgcccaggcgctgatcgacgaccagggcaacacgctgcagactcggcgcaagctcaagccgacgcacgtggagcgcaccgtgttcggcgagggcgacggatcggacctgagcgtggtcgagacggctatcggcaacatcggctcgctgtcgtgctgggagcacctgcagccgctcagcaagtacgcgatgtactcgcagaacgagcagatccattgcggcgcctggcccagcttctcgctctaccgcggcggcgcctacgcgctcggcgccgaagtgaacaacgccgccagccaggtgtacgcggccgagggccagtgcttcgtgatcgcgccctgcgccacggtctcgaaggcgatgcacgaactgctgtgcaccgaccctggcaagcagcagatgctgctggtcggcggcggcttcgcgcgcatctacggacccgacggatcgccgctcggcaagaacctggcagaggacgaggaagggctggtggtggccgacatcgacctcggcatgatctccctggccaaggcggccggcgacccggccggccactattcgcggcccgacgtgacgcagttgctgttcaacaggaagcggcgcgagccggtggtgctgcaaggcccggccgagcccgagaaggcggtcgccgagccggtgtccacgccgagcgaagcggcggcggccgccgcccgccagccggtcgtggcctga

SEQ ID NO: 378 - protein, 349 aa, Unknown
  Obtained from an environmental sample
MSSTTHPRLRVAAVQAAPVFLDLDGTIDKTIDLMARAAGQGVQLIAFPETWVPGYPWWIWLDSPAWGMQFVQRYHDNALVVGSPEFDRIREAARKHRIWVSLGYSEKAAGSLYIAQALIDDQGNTLQTRRKLKPTHVERTVFGEGDGSDLSVVETAIGNIGSLSCWEHLQPLSKYAMYSQNEQIHCGAWPSFSLYRGGAYALGAEVNNAASQVYAAEGQCFVIAPCATVSKAMHELLCTDPGKQQMLLVGGGFARIYGPDGSPLGKNLAEDEEGLVVADIDLGMISLAKAAGDPAGHYSRPDVTQLLFNRKRREPVVLQGPAEPEKAVAEPVSTPSEAAAAAARQPVVA

SEQ ID NO: 379 - DNA, 936 bp, Unknown
  Obtained from an environmental sample
atggctaaaatagcgattgtacaaaaggcgtctgttaccttgaataaacaagaaactgtcgccagtgctgtaagagaggtagagctggcagcggcggaaggtgccgagctggtagtgtttactgaggcatttattgctgggtatccggcctggatctggcgtttgcggccaggtggtgactgggggctatctgaagatcttcattcccgtttgttgacaagcgccgtagacctgggtggtgatgacctggatccactttatgccgcagctaaagaaaataacgtgacgatagtgtgcggtattaatgaacgtgataaccggctcagtaaggcaacgctatataattctatcgttattattggttccgatggttcattgttaaatcgacatcgtaagttgatgccgacgaatccggagagaatggtatggggctttggtgatgcctctggtctgaaggtcgttgatacccccgttggtcgtgttggtacgcttgtctgttgggaaaactatatgcccttggccagatatgcgttgtattcgcagggggtagaggtttatattgcgccgacctacgatagcggtgatgactggatttctacattacagcatattgccagggagggtcgttgttgggttgttggctgtggcaatctattgcgtggcagcgatataccggatgacttccctgagaagttggcgttatacccagatgaggatgagtggataaatcctggggattccgttgtgattgcacctgggggtaaaatcatggccgggccattgcgccaggaggcggggattgtctattgtgatattgcgtctgaaagtgccagtcaggcaaaacgtgcgctggatgtggctggacattattcccggcctgatatctttgagttgcatgtgaatacgaaggtgcagaccccggttgtatatgattag

SEQ ID NO: 380 - protein, 311 aa, Unknown
  Obtained from an environmental sample
MAKIAIVQKASVTLNKQETVASAVREVELAAAEGAELVVFTEAFIAGYPAWIWRLRPGGDWGLSEDLHSRLLTSAVDLGGDDLDPLYAAAKENNVTIVCGINERDNRLSKATLYNSIVIIGSDGSLLNRHRKLMPTNPERMVWGFGDASGLKVVDTPVGRVGTLVCWENYMPLARYALYSQGVEVYIAPTYDSGDDWISTLQHIAREGRCWVVGCGNLLRGSDIPDDFPEKLALYPDEDEWINPGDSVVIAPGGKIMAGPLRQEAGIVYCDIASESASQAKRALDVAGHYSRPDIFELHVNTKVQTPVVYD

SEQ ID NO: 381 - DNA, 945 bp, Clostridium acetobutylicum ATCC 3625
atgggcgaattcggtgaagttaccctgggcgtggctcaggctgctcccgtgtactttgaccgcgaggcctcgaccgagaaagcctgtggcctgatccgcgaggcgggcgaaaagggtgtagatcttctggcgttcggtgaaacgtggttaaccggctatccatactggaaagatgcgccttggtctcgcgaatacaacgacttgcgtgcacgttatgttgcgaacggtgtgatgattcctggtccggaaacggacgctctgtgccaagcagccgcggaagcaggtgtggatgtggcgatcggagtagtagaactggagccgggctctctttcctcggtttattgcactctgttatttataagccgcgagggcgagatcctgggtcgtcaccgcaaactgaaaccgaccgatagcgaacgtcgttactggtctgaaggcgacgcgactggtctgcgcgtttatgagcgcccatatggtcggcttagcggcctgaattgctgggagcacactatgatgctgccggggtacgccctggcggcgcagggcacccagttccatgtggccgcttggccaaacatggcatcctcgaattctgaacttctgtctcgtgcctacgctatgcaggcgggctgctacgttttatgcgcgggtggcctgggcccggccccaggtgaactgccggatggtatcgcggcggaaagtttagatcacttgactggagagtcatgtatcatcgacccgtgggggaaagtaattgctggtccggtgtcttgcgaggaaacccttatcacggctcgcgttagcaccgcatctatttatcgccgcaaaagtttgacggacgtgggcggtcattatagccgcccggatgttttccgttttgaagtcgatcgctctgagcgtccccgtgtcgtgtttcgcgatggtgacgtggatgaccgaggttaa

SEQ ID NO: 382 - protein, 314 aa, Clostridium acetobutylicum ATCC 3625
MGEFGEVTLGVAQAAPVYFDREASTEKACGLIREAGEKGVDLLAFGETWLTGYPYWKDAPWSREYNDLRARYVANGVMIPGPETDALCQAAAEAGVDVAIGVVELEPGSLSSVYCTLLFISREGEILGRHRKLKPTDSERRYWSEGDATGLRVYERPYGRLSGLNCWEHTMMLPGYALAAQGTQFHVAAWPNMASSNSELLSRAYAMQAGCYVLCAGGLGPAPGELPDGIAAESLDHLTGESCIIDPWGKVIAGPVSCEETLITARVSTASIYRRKSLTDVGGHYSRPDVFRFEVDRSERPRVVFRDGDVDDRG

SEQ ID NO: 383 - DNA, 1041 bp, Unknown
  Obtained from an environmental sample
atgtcggagcccatgacgaagtatcgcggcgcggcggtgcaggccgcgccggtgttcctcgatctcgaccgcacagtcgagaaagcgatcggcctgatcgagcaggcggccaagcaggacgtgcgcctgatcgcattcccagagacttggattcccggctatcccttttggatatggctgggcgcgccggcttggggcatgcgcttcgtccagcgctatttcgagaattcgctcgtgcgcggcagcaagcagtggcaggccctggcggatgcggcccgccgccacggcatgcatgtcgtggccggctatagcgagcgcgcgggcggcagcctctatatgggccaggcgatcttcggccccgatggcgatctgatcgccgcgcgccgcaagctcaagcctacccatgcggagcgcaccgtgttcggcgagggagacggcagccatctcgcggtgcacgataccgccatcgggcgcctcggcgcgctctgttgctgggagcacatccagccattgtcgaaatacgccatgtacgccgccgacgaacaggtccacgtcgcgtcgtggccgagcttcagcctctatcgcggcatggcctatgcgctcggaccggaggtcaataccgccgcaagccagatctacgcggtcgagggcggctgctacgtgctggcgtcgtgcgcgaccgtttcgccggagatgatcaaggtattggtggatacgcccgacaaggagatgttcctcaaggccggcggcggttttgccatgattttcgggcccgacggccgcgccctggccgagccgctcccggagaccgaagagggactgctggtcgccgatatcgacctcggcatgatcgcgttggccaaggcggcggccgatccggcgggccactattcacggcccgacgtaacgcggctgctgctggatcgacgtccggcccaacgcgtcgtcacgcttgatgccgcattcgaaccgcaaaacgaggacaagggcgacgcgcccgcgctgcgcgtggtggcggaaagcgccgccgccgcgcagtag

SEQ ID NO: 384 - protein, 346 aa, Unknown
  Obtained from an environmental sample
MSEPMTKYRGAAVQAAPVFLDLDRTVEKAIGLIEQAAKQDVRLIAFPETWIPGYPFWIWLGAPAWGMRFVQRYFENSLVRGSKQWQALADAARRHGMHVVAGYSERAGGSLYMGQAIFGPDGDLIAARRKLKPTHAERTVFGEGDGSHLAVHDTAIGRLGALCCWEHIQPLSKYAMYAADEQVHVASWPSFSLYRGMAYALGPEVNTAASQIYAVEGGCYVLASCATVSPEMIKVLVDTPDKEMFLKAGGGFAMIFGPDGRALAEPLPETEEGLLVADIDLGMIALAKAAADPAGHYSRPDVTRLLLDRRPAQRVVTLDAAFEPQNEDKGDAPALRVVAESAAAAQ

SEQ ID NO: 385 - DNA, 1014 bp, Unknown
  Obtained from an environmental sample
atgaaagaagctatcaaggtcgcctgcgtgcaagccgccccgatctacatggatttgaaggcgacggtggacaaaaccattgagttgatggaagaagcagcacgtaataatgctcgtctgatcgcctttccggaaacttggattccaggctacccatggtttctttggcttgactcaccagcatgggcaatgcaatttgtacgccaataccatgagaactcattggagttggatggccctcaagctaagcgcatttcagatgcagccaagcggttgggaatcatggtcaccctggggatgagtgaacgggtcggtggcaccctttacatcagtcagtggttcataggcgataatggtgacaccattggggcccggcgaaagttgaaacctacttttgttgaacgtactttgttcggcgaaggggatggttcatcgctagcggttttcgagacgtctgttggaaggctgggtggcttatgctgttgggagcaccttcaaccgctaacaaaatacgctttgtatgcacaaaatgaagagattcattgtgcggcttggccgagctttagcctttatcctaatgcggcgaaagccctggggcctgatgtcaatgtagcggcctctcgaatctatgccgttgaagggcaatgcttcgtactagcgtcgtgtgcgctcgtttcacaatccatgatcgatatgctttgtacagatgacgaaaagcatgcgttgcttctggctggtggtggacactcacgtatcatagggcctgatggtggtgacttggtcgcgcctcttgccgaaaatgaagagggtattctctacgcaaaccttgatcctggagtacgcatccttgctaaaatggcggcagaccctgctggtcattattcccgtcccgacattactcgcttgctaatagatcgcagccctaaattaccggtagttgaaattgaaggtgatcttcgtccttacgctttgggtaaagcgtctgagacgggtgcgcaactcgaagaaatttga

SEQ ID NO: 386 - protein, 337 aa, Unknown
  Obtained from an environmental sample
MKEAIKVACVQAAPIYMDLKATVDKTIELMEEAARNNARLIAFPETWIPGYPWFLWLDSPAWAMQFVRQYHENSLELDGPQAKRISDAAKRLGIMVTLGMSERVGGTLYISQWFIGDNGDTIGARRKLKPTFVERTLFGEGDGSSLAVFETSVGRLGGLCCWEHLQPLTKYALYAQNEEIHCAAWPSFSLYPNAAKALGPDVNVAASRIYAVEGQCFVLASCALVSQSMIDMLCTDDEKHALLLAGGGHSRIIGPDGGDLVAPLAENEEGILYANLDPGVRILAKMAADPAGHYSRPDITRLLIDRSPKLPVVEIEGDLRPYALGKASETGAQLEEI

What is claimed is:

1. An isolated, synthetic or recombinant nucleic acid, encoding a polypeptide having nitrilase activity, comprising
   (a) a nucleic acid having a sequence at least 90%, 91%, 92%, 93%, 94%, 95%, 96%, 97%, 98%, 99%, or more, or complete identity (100% identical) to SEQ ID NO:209; or
   (b) a nucleic acid encoding a polypeptide comprising amino acids having a sequence at least 90%, 91%, 92%, 93%, 94%, 95%, 96%, 97%, 98%, 99%, or more, or complete identity (100% identical) to SEQ ID NO:210; or
   (c) a nucleic acid completely complementary to (a) or (b).

2. A nucleic acid vector capable of replication in a host cell, wherein the vector comprises the nucleic acid of claim 1.

3. A host cell comprising the nucleic acid of claim 1.

4. A host organism comprising the host cell of claim 3.

5. The isolated, synthetic or recombinant nucleic acid of claim 1, wherein the nucleic acid is affixed to a solid support, wherein optionally the solid support is selected from the group of a gel, a resin, a polymer, a ceramic, a glass, a microelectrode and any combination thereof.

6. A method for making a polypeptide having nitrilase activity, the method comprising
   (a) introducing the nucleic acid of claim 1 encoding the polypeptide into a host cell under conditions that permit production of the polypeptide by the host cell, and
   (b) recovering the recombinant polypeptide so produced.

7. A kit comprising the nucleic acid of claim 1, or a fragment thereof encoding a polypeptide having nitrilase activity, and a buffer.

8. The isolated, synthetic or recombinant nucleic acid of claim 1, having at least 95% sequence identity to SEQ ID NO:209.

9. The isolated, synthetic or recombinant nucleic acid of claim 1, having at least 98% sequence identity to SEQ ID NO:209.

10. The isolated, synthetic or recombinant nucleic acid of claim 1, having at least 99% sequence identity to SEQ ID NO:209.

11. The isolated, synthetic or recombinant nucleic acid of claim 1, further consisting of one or more mutations, wherein:
nucleotides 163-165 of SEQ ID NO:209 are substituted with AAA, AAG, GGT, GGC, GGA, GGG, CAA, or CAG;
nucleotides 178-180 of SEQ ID NO:209 are substituted with GAA or GAG;
nucleotides 331-333 of SEQ ID NO:209 are substituted with TCT, TCC, TCA, TCG, AGT, or AGC;
nucleotides 568-570 of SEQ ID NO:209 are substituted with CAT, CAC, TCT, TCC, TCA, TCG, AGT, AGC, ACT, ACC, ACA, TCA, TAT, TAC, ATG or ACG;
nucleotides 571-573 of SEQ ID NO:209 are substituted with TTA, TTG, CTT, CTC, CTA, CTG, GTT, GTC, GTA, GTG, ATG, ACT, ACC, ACA, GAT, GAC, GGT, GGC, GGA, GGG, GAA, GAG, TAT, TAC, or ACG;
nucleotides 595-597 of SEQ ID NO:209 are substituted with GAA, GAG, TTA, TTG, CTT, CTC, CTA, or CTG;
nucleotides 664-666 of SEQ ID NO: 209 are substituted with TTA, TTG, CTT, CTC, CTA, or CTG; or any combination thereof.

* * * * *